United States Patent
Wang et al.

(10) Patent No.: US 9,617,314 B2
(45) Date of Patent: Apr. 11, 2017

(54) **POLYPEPTIDES AND BACTERIOPHAGES SPECIFIC TO *KLEBSIELLA PNEUMONIAE* CAPSULAR TYPE STRAINS**

(75) Inventors: Jin Town Wang, Taipei (TW); Tzu Lung Lin, Taipei (TW)

(73) Assignee: NATIONAL TAIWAN UNIVERSITY, Taipei (TW)

( * ) Notice: Subject to any disclaimer, the term of this patent is extended or adjusted under 35 U.S.C. 154(b) by 333 days.

(21) Appl. No.: 14/112,870

(22) PCT Filed: Apr. 20, 2012

(86) PCT No.: PCT/US2012/034525
§ 371 (c)(1),
(2), (4) Date: May 19, 2014

(87) PCT Pub. No.: WO2012/145676
PCT Pub. Date: Oct. 26, 2012

(65) Prior Publication Data
US 2014/0295528 A1    Oct. 2, 2014

Related U.S. Application Data

(60) Provisional application No. 61/477,317, filed on Apr. 20, 2011.

(51) Int. Cl.
*C07K 14/005* (2006.01)
*C12N 7/00* (2006.01)
*C07H 21/04* (2006.01)

(52) U.S. Cl.
CPC ........... *C07K 14/005* (2013.01); *C07H 21/04* (2013.01); *C12N 7/00* (2013.01); *C12N 2795/00021* (2013.01); *C12N 2795/00022* (2013.01); *C12N 2795/00032* (2013.01); *C12N 2795/00033* (2013.01); *C12N 2795/10221* (2013.01); *C12N 2795/10222* (2013.01); *C12N 2795/10232* (2013.01); *C12N 2795/10233* (2013.01)

(58) Field of Classification Search
None
See application file for complete search history.

(56) References Cited

U.S. PATENT DOCUMENTS

2003/0216338 A1    11/2003    Merril et al.

FOREIGN PATENT DOCUMENTS

WO    2012145676    10/2012

OTHER PUBLICATIONS

Office Action (document No. 10320882360) of the corresponding Taiwanese application 101114318 dated Jun. 27, 2014 and its relevant English translation.
Taiwanese application 101114318 (document No. 10320882360). Cloning and functional characterization of a putative endolysin in Klebsiella pneumoniae (Master's dissertation, Kai-chiang Tung, Department of Microbiology, National Taiwan University, National Central Library publication date: Aug. 25, 2008; the abstract, p. 2 to the first paragraph on p. 5, page 6, the first paragraph on p. 8, p. 17 to the first paragraph on p. 1) and its English translation of the abstract.

*Primary Examiner* — Nicole Kinsey White
(74) *Attorney, Agent, or Firm* — WPAT, P.C., Intellectual Property Attorneys; Anthony King

(57) ABSTRACT

The present invention relates to novel bacteriophages specific to *Klebsiella pneumoniae* strains, and compositions comprising the same. Particularly, polypeptides and their coding nucleic acid molecule of the novel bacteriophages are provided. The invention also relates to applications of the novel bacteriophages and the polypeptides in the detection/treatment/prevention of infection caused by *Klebsiella pneumoniae* strains. Development of immunogen and vaccine on the basis of the polypeptides are also provided.

6 Claims, 9 Drawing Sheets

POLYPEPTIDES AND BACTERIOPHAGES SPECIFIC TO *KLEBSIELLA PNEUMONIAE* CAPSULAR TYPE STRAINS

This application relates to and claims the benefit of priority to U.S. provisional application Ser. No. 61/477,317 filed on Apr. 20, 2011, the disclosure of which is herein incorporated by reference in its entirety.

FIELD OF THE INVENTION

The present invention relates to plural polypeptides and bacteriophages specific to degrade capsule of *Klebsiella pneumoniae*, and compositions comprising the same. The invention also relates to applications of the polypeptides and bacteriophages in the detection/treatment/prevention of infection caused by *Klebsiella pneumoniae*.

BACKGROUND OF THE INVENTION

The genus *Klebsiella* belongs to the family Enterobacteriaceae and is divided into at least 4 species. They are gram-negative, capsulated, oxidase-negative, non-motile, straight rods. They are facultative anaerobes, having both respiratory and fermentative metabolisms. Most strains can use citrate and glucose as their sole carbon source. Some strains can fix nitrogen. They are commonly found in intestines, clinical samples, soil, water and grains.

*Klebsiella pneumoniae*, a Gram-negative enteric bacterium, is a common pathogen that causes hospital-acquired urinary tract infections, septicemia and pneumonia as well as community-acquired pneumonia. Community-acquired pyogenic liver abscess (PLA) caused by *Klebsiella pneumoniae* complicated with metastatic meningitis and endophthalmitis has emerged globally, especially in Asia. The mortality rates are 10% for those with *Klebsiella pneumoniae* PLA, and 30-40% among those with metastatic meningitis. Persons who survived meningitis usually have severe neurological sequelae. Patients who suffer from *K. pneumoniae* endophthalmitis usually become blind in the affected eye. Therefore, prevention, rapid diagnosis and proper treatment for this invasive disease are required.

There are more than 75 traditional capsular serotypes defined by antisera in *Klebsiella*. Immunological diagnosis is usually used to identify the capsular serotypes of *Klebsiella*. However, the anti-sera are expensive and have to be purchased from limited resources. Dietlinde Rieger-Hug and Stephan Stirm conducted a comparative study if host capsule depolymerase associated with *Klebsiella* bacteriophages and proves that the viral depolymerases are very specific (Dietlinde Rieger-Hug and Stephan Stirm, *Comparative study of host capsule depolymerases associated with Klebsiella bacteriophages*, 1981, *Virology*, 113, 363-378). A study of capsular serotypes in bacteremic *Klebsiella pneumoniae* isolates in Taiwan showed that 52 out of 94 isolates (55%) from community-acquired infections and 48 out of 64 isolates (75%) from noaocomial infections were non-typable (Tsay R W, Siu L K, Fung C P, Chang F Y. *Characteristics of bacteremia between community-acquired and nosocomial Klebsiella pneumoniae infection: risk factor for mortality and the impact of capsular serotypes as a herald for community-acquired infection*. Arch Intern Med. 2002 May 13; 162(9):1021-7). A previous survey from Australia on the serotypes of 293 *K. pneumoniae* isolates reported that 88 isolates (30%) were non-typable by counter-current immunoelectrophoresis (CIE), while 54 had a positive reaction to more than one serotype (Jenney A W, Clements A, Farn J L, Wijburg O L, McGlinchey A, Spelman D W, Pitt T L, Kaufmann M E, Liolios L, Moloney M B, Wesselingh S L, Strugnell R A. *Seroepidemiology of Klebsiella pneumoniae in an Australian Tertiary Hospital and its implications for vaccine development*. J Clin Microbiol. 2006; 44(1):102-7). Therefore, it is difficult to identify *Klebsiella pneumoniae* using serotyping.

Capsular serotype K1 and K2 are considered to be the predominant virulent strains of *Klebsiella pneumoniae*. Further investigation has found K1 to be the most common serotype isolated from patients with *Klebsiella pneumoniae* PLA and endophthalmitis (Fung C P, Chang F Y, Lee S C, et al. *Gut* 2002; 50:420-4). K1 has been further investigated as the most common serotype isolated from patients with *Klebsiella pneumoniae* liver abscess and endophthalmitis. Mucoviscosity has been documented as a virulence factor of *Klebsiella pneumoniae*. Using transposon mutagenesis, a virulence gene, magA, was identified, which was involved in the hypermucoviscosity phenotype and also played an important role in resistance to serum and phagocytosis. It is reported in "*The Journal of Infectious Diseases*, 2006; 193:645-54" that magA and its flanking regions might be associated with capsular polysaccharide biosynthesis, and magA-containing chromosomal region encodes capsular structure and is specific for the K1 serotype.

Bacteriophages are bacterial viruses that attach to their specific hosts and kill them by internal replication and bacterial lysis involving a complex lytic cycle involving several structural and regulatory genes. Bacteriophages are very specific in that they only attack their targeted bacterial hosts. Accordingly, bacteriophages are considered to be a potentially powerful cure for and diagnosis means of bacterial infections. Previous studies report that bacteriophage-infected encapsulated bacteria often carried the capsule-degrading enzymes, so such enzymes may be used as a marker to identify bacterial species and detect and treat bacterial infection. U.S. Pat. No. 7,405,066 discloses a bacteriophage capable of lysing a *Propionibacterium acnes* bacterium and its use in the treatment of acne.

However, a number of bacteriophages specific to *Klebsiella pneumoniae* strains have not been found. There remains in the art a need for the discovery of novel bacteriophages specific to *Klebsiella pneumoniae* capsular type, and identifying methods for using these bacteriophages in several critical areas, including therapy and diagnosis of infection caused by *Klebsiella pneumoniae*.

SUMMARY OF THE INVENTION

The invention relates to an isolated polypeptide having degradation activity specific to the capsule types of *Klebsiella pneumoniae* capsular strains, selected from the group consisting of: (a) a polypeptide comprising an amino acid sequence which has at least 60% sequence identity with the polypeptide of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, or 96; (b) a polypeptide which is encoded by a polynucleotide which hybridizes under at least high stringency conditions with (i) the polypeptide coding sequence of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93 or 95 or (ii) a full-length complementary strand of (i); and (c) a polypeptide which is encoded by a polynucleotide having at least 60% sequence identity with the polypeptide coding sequence of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93 or 95.

The invention also relates to an isolated polynucleotide comprising or consisting of a nucleotide sequence which encodes a polypeptide of the present invention having degradation activity specific to capsule of *Klebsiella pneumoniae*. Vectors and host cells containing the polynucleotide are also provided.

The invention also provides isolated or recombinant bacteriophages of *Klebsiella pneumoniae* capsular type strains.

The invention is directed to a composition comprising one or more of the above-mentioned polypeptide or the bacteriophage, or its progeny, recombinants and derivatives and the use of the one or more of the above-mentioned polypeptide or bacteriophage, or its progeny, recombinants and derivatives, to control the growth or colonization of *Klebsiella pneumoniae* strains. The invention also provides methods of identifying *Klebsiella pneumoniae* strains as a bacterial diagnostic and/or detecting the presence of *Klebsiella pneumoniae* strains in a sample. The invention further provides methods of using one or more of the above-mentioned polypeptide or bacteriophage or its progeny, recombinants and derivatives for the removal of antibiotic-resistant or other undesirable pathogens from medical, veterinary, animal husbandry, or any additional environments. The invention additionally provides for methods of using one or more of the above-mentioned polypeptide or bacteriophage to prevent and/or treat human and animal diseases caused by *Klebsiella pneumoniae* strains.

DETAILED DESCRIPTION OF THE INVENTION

Figure 1:
FIG. 1 shows plaques observed in the culture medium incubated with *Klebsiella pneumoniae* NTUH-K2044 strain (a *Klebsiella pneumoniae* capsular type K1 strain).

The invention is directed to polypeptides and bacteriophages specific to capsule of *Klebsiella pneumoniae* strains.

Definitions

A "phenotype", as used herein, refers to any observable property of an organism that is dependent upon the genome of the organism. A phenotype can be further characterized as modulated by a non-genetic factor, an interaction between two or more non-genetic factors, an interaction between a genetic locus and a non-genetic factor, or an interaction between two or more genetic loci and non-genetic factors.

"Phenotyping" refers to a method for assaying a phenotype. A phenotyping method is in one embodiment amenable to high-throughput formats so that a phenotype of each of the cells of the library is rapidly assessed. Cells that display a phenotype of interest can be selected, and subsequent phenotyping can be performed in chimeric or cloned organisms.

An "isolated polynucleotide", as used herein, is a polynucleotide that is separated from other nucleic acid molecules that are usually associated with the isolated nucleic acid molecule. Thus, an "isolated" polynucleotide includes, without limitation, a polynucleotide that is free of sequences that naturally flank one or both ends of the nucleic acid in the genome of the organism from which the isolated nucleic acid is derived (e.g., a cDNA or genomic DNA fragment produced by PCR or restriction endonuclease digestion). Such an isolated nucleic acid molecule is generally introduced into a vector (e.g., a cloning vector, or an expression vector) for convenience of manipulation or to generate a fusion nucleic acid molecule. In addition, an isolated nucleic acid molecule can include an engineered nucleic acid molecule such as a recombinant or a synthetic nucleic acid molecule. A polynucleotide existing among hundreds to millions of other polynucleotides within, for example, a nucleic acid library (e.g., a cDNA, or genomic library) or a portion of a gel (e.g., agarose, or polyacrylamine) containing restriction-digested genomic DNA is not to be considered an isolated nucleic acid.

An "isolated polypeptide", as used herein, refers to a polypeptide that has been separated from other proteins, lipids, and nucleic acids with which it is naturally associated. The polypeptide can constitute at least 10, 20, 50 70, 80 or 95% by dry weight of the purified preparation.

The "subsequence" as used herein is defined herein as a nucleotide sequence having one or more nucleotides deleted from the 5' and/or 3' end of a polypeptide coding sequence; or a homologous sequence thereof; wherein the subsequence encodes a polypeptide fragment having degradation activity to capsule of *Klebsiella pneumoniae*.

The "coding sequence" means a nucleotide sequence, which directly specifies the amino acid sequence of its protein product.

The "hybridization" as used herein refers to the process by which a nucleic acid strand joins with a complementary strand through base pairing. Hybridization reactions can be sensitive and selective so that a particular sequence of interest can be identified even in samples in which it is present at low concentrations. Suitably stringent conditions can be defined by, for example, the concentrations of salt or formamide in the prehybridization and hybridization solutions, or by the hybridization temperature, and are well known in the art. In particular, stringency can be increased by reducing the concentration of salt, increasing the concentration of formamide, or raising the hybridization temperature. For example, hybridization under high stringency conditions could occur in about 50% formamide at about 37° C. to 42° C. Hybridization could occur under reduced stringency conditions in about 35% to 25% formamide at about 30° C. to 35° C. In particular, hybridization could occur under high stringency conditions at 42° C. in 50% formamide, 5×SSPE, 0.3% SDS, and 200 n/ml sheared and denatured salmon sperm DNA. Hybridization could occur under reduced stringency conditions as described above, but in 35% formamide at a reduced temperature of 35° C. The temperature range corresponding to a particular level of stringency can be further narrowed by calculating the purine to pyrimidine ratio of the nucleic acid of interest and adjusting the temperature accordingly. Variations on the above ranges and conditions are well known in the art.

The "percent identity", as used herein, of two amino acid sequences or of two nucleic acids is determined using the algorithm of Karlin and Altschul (1990) Proc. Natl. Acad. Sci. USA 87:2264-2268, modified as in Karlin and Altschul (1993) Proc. Natl. Acad. Sci. USA 90:5873-5877. Such an algorithm is incorporated into the BLASTN and BLASTX programs (version 2.0) of Altschul et al. (1990) J. Mol. Biol. 215:403-10. BLAST nucleotide searches can be performed with the BLASTN program, score=100, wordlength=12 to obtain nucleotide sequences homologous to the nucleic acid molecules of the invention. BLAST protein searches can be performed with the BLASTX program, score=50, wordlength=3 to obtain amino acid sequences homologous to the protein molecules of the invention. Where gaps exist between two sequences, Gapped BLAST can be utilized as described in Altschul et al. (1997) Nucleic Acids Res. 25:3389-3402. When BLAST and Gapped BLAST programs are utilized, the default parameters of the respective programs (e.g., BLASTX and BLASTN) can be used.

An "open reading frame", also referred to herein as ORF, is a region of nucleic acid which encodes a polypeptide. This region usually represents the total coding region for the polypeptide and can be determined from a stop to stop codon or from a start to stop codon.

The term "fragment", as used herein, will ordinarily be at least about 20 residues, more typically at least about 40 residues, preferably at least about 60 residues in length. Fragments of the ORF33 polypeptides can be generated by methods known to those skilled in the art.

"Operably linked", as used herein, refers to sequences joined or ligated to function in their intended manner. For example, a control sequence is operably linked to coding sequence by ligation in such a way that expression of the coding sequence is achieved under conditions compatible with the control sequence and host cell.

As used herein, "host cells" and other such terms denoting prokaryotic or eukaryotic cell lines cultured as unicellular entities refer to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

A "sample" as used herein refers to a biological sample, such as, for example, tissue or fluid isolated from a subject (including without limitation plasma, serum, cerebrospinal fluid, lymph, tears, saliva and tissue sections) or from in vitro cell culture constituents, as well as samples from the environment.

A "therapeutically effective amount", as used herein, means an amount sufficient to reduce the incidence of disease by at least 30%, preferably 50%, more preferably 75%, and most preferably by at least about 90%.

A "vaccine", as used herein, is a composition comprising an immunogen and a pharmaceutical carrier. A vaccine may be comprised of a whole infectious agent or components of the infectious agent produced by the infectious agent, another infectious agent or synthetically or recombinantly are administered to stimulate an immune response that will subsequently protect a person from illness caused by that agent. A therapeutic (treatment) vaccine is given after infection and is intended to reduce or arrest disease progression. A preventive (prophylactic) vaccine is intended to prevent initial infection. A vaccine may further comprise a diluent, an adjuvant, a carrier, or combinations thereof, as would be readily understood by those in the art.

Various aspects of the invention are described in further detail in the following subsections:
Polypeptide Specifically Degrading Capsule of *Klebsiella pneumonia*
1. Polypeptide Specifically Degrading Capsule of *Klebsiella pneumoniae* Capsular Type K1 Strains The invention provides an isolated polypeptide having degradation activity specific to the capsule of *Klebsiella pneumoniae* capsular type K1 strains, selected from the group consisting of: (a) a polypeptide comprising an amino acid sequence which has at least 60% sequence identity with the polypeptide of SEQ ID NO: 2; (b) a polypeptide which is encoded by a polynucleotide which hybridizes under at least high stringency conditions with (i) the polypeptide coding sequence of SEQ ID NO: 1, or (ii) a full-length complementary strand of (i); and (c) a polypeptide which is encoded by a polynucleotide having at least 60% sequence identity with the polypeptide coding sequence of SEQ ID NO: 1.

In a first aspect, the present invention relates to isolated polypeptides comprising an amino acid sequence which has a degree of identity to the polypeptide of SEQ ID NO: 2 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K1 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 2.

A polypeptide of the present invention preferably comprises the amino acid sequence of SEQ ID NO: 2 or an allelic variant thereof; or a fragment thereof that has degradation activity specific to the capsule of *Klebsiella pneumoniae* capsular type K1 strains. In a preferred aspect, a polypeptide comprises the amino acid sequence of SEQ ID NO: 2. In another preferred aspect, a polypeptide consists of the amino acid sequence of SEQ ID NO: 2 or an allelic variant thereof; or a fragment thereof that has degradation activity specific to the capsule of *Klebsiella pneumoniae* capsular type K1 strains. In another preferred aspect, a polypeptide consists of the amino acid sequence of SEQ ID NO: 2.

In a second aspect, the present invention relates to an isolated polypeptide having degradation activity specific to the capsule of *Klebsiella pneumoniae* capsular type K1 strains which are encoded by a polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polynucleotide of SEQ ID NO: 1, (ii) a subsequence of (i) or (ii), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 1 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K1 strains. In a preferred aspect, the polypeptide coding sequence is the polynucleotide as shown in SEQ ID NO: 1. In another preferred aspect, the complementary strand is the full-length complementary strand of the polypeptide coding sequence of SEQ ID NO: 1.

In a third aspect, the present invention relates to an isolated polypeptide encoded by a polynucleotide comprising or consisting of nucleotide sequences which have a degree of identity to the sequence of SEQ ID NO: 1 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleotide sequence of SEQ ID NO: 1. See polynucleotide section herein.

In a fourth aspect, the present invention relates to artificial variants comprising a substitution, deletion, and/or insertion of one or more amino acids of the polypeptide of SEQ ID NO: 2; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

2. Polypeptide Specifically Degrading Capsule of *Klebsiella pneumoniae* Capsular Type K2 and/or K13 Strains The invention provides an isolated polypeptide having degradation activity specific to the capsule of *Klebsiella pneumoniae* capsular type K2 and/or K13 strains, selected from the group consisting of: (a) a polypeptide comprising an amino acid sequence which has at least 60% sequence identity with the mature polypeptide of SEQ ID NO: 4; (b) a polypeptide which is encoded by a polynucleotide which hybridizes under at least high stringency conditions with (i) the polypeptide coding sequence of SEQ ID NO: 3, (ii) a full-length complementary strand of (i); and (c) a polypeptide which is encoded by a polynucleotide having at least 60% sequence identity with the polypeptide coding sequence of SEQ ID NO: 3.

In a first aspect, the present invention relates to an isolated polypeptide comprising an amino acid sequence which has a degree of identity to the polypeptide of SEQ ID NO: 4 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K2 and/or K13 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 4.

A polypeptide of the present invention preferably comprises the amino acid sequence of SEQ ID NO: 4 or an allelic variant thereof; or a fragment thereof that has degradation activity specific to the capsule of *Klebsiella pneumoniae* capsular type K2 and/or K13 strains. In a preferred aspect, a polypeptide comprises the amino acid sequence of SEQ ID NO: 4. In another preferred aspect, a polypeptide consists of the amino acid sequence of SEQ ID NO: 4 or an allelic variant thereof; or a fragment thereof that has degradation activity specific to the capsule of *Klebsiella pneumoniae* capsular type K2 and/or K13 strains. In another preferred aspect, a polypeptide consists of the amino acid sequence of SEQ ID NO: 4.

In a second aspect, the present invention relates to an isolated polypeptide having degradation activity specific to the capsule of *Klebsiella pneumoniae* capsular type K2 and/or K13 strains which are encoded by polynucleotides which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 3, (ii) a subsequence of (i) or (ii), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 3 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K2 and/or K13 strains. In a preferred aspect, the polypeptide coding sequence is nucleotides as shown in SEQ ID NO: 3. In another preferred aspect, the complementary strand is the full-length complementary strand of the polypeptide coding sequence of SEQ ID NO: 3.

In a third aspect, the present invention relates to an isolated polypeptide encoded by polynucleotides comprising or consisting of nucleotide sequences which have a degree of identity to the sequence of SEQ ID NO: 3 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 3. See polynucleotide section herein.

In a fourth aspect, the present invention relates to artificial variants comprising a substitution, deletion, and/or insertion of one or more amino acids of the polypeptide of SEQ ID NO: 4; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

3. Polypeptide Specifically Degrading Capsule of *Klebsiella pneumoniae* Capsular Type K3 Strains The invention provides an isolated polypeptide having degradation activity specific to the capsule of *Klebsiella pneumoniae* capsular type K3 strains, selected from the group consisting of: (a) a polypeptide comprising an amino acid sequence which has at least 60% sequence identity with the mature polypeptide of SEQ ID NO: 6; (b) a polypeptide which is encoded by a polynucleotide which hybridizes under at least high stringency conditions with (i) the polypeptide coding sequence of SEQ ID NO: 5, (ii) a full-length complementary strand of (i); and (c) a polypeptide which is encoded by a polynucleotide having at least 60% sequence identity with the mature polypeptide coding sequence of SEQ ID NO: 5.

In a first aspect, the present invention relates to an isolated polypeptide comprising an amino acid sequence which has a degree of identity to the polypeptide of SEQ ID NO: 6 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K3 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 6.

A polypeptide of the present invention preferably comprises the amino acid sequence of SEQ ID NO: 6 or an allelic variant thereof; or a fragment thereof that has degradation activity specific to the capsule of *Klebsiella pneumoniae* capsular type K3 strains. In a preferred aspect, a polypeptide comprises the amino acid sequence of SEQ ID NO: 6. In another preferred aspect, a polypeptide consists of the amino acid sequence of SEQ ID NO: 6 or an allelic variant thereof; or a fragment thereof that has degradation activity specific to the capsule of *Klebsiella pneumoniae* capsular type K3 strains. In another preferred aspect, a polypeptide consists of the amino acid sequence of SEQ ID NO: 6.

In a second aspect, the present invention relates to an isolated polypeptide having degradation activity specific to the capsule of *Klebsiella pneumoniae* capsular type K3 strains which are encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 5, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 5 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K3 strains. In a preferred aspect, the polypeptide coding sequence is nucleotides as shown in SEQ ID NO: 5. In another preferred aspect, the complementary strand is the full-length complementary strand of the polypeptide coding sequence of SEQ ID NO: 5.

In a third aspect, the present invention relates to an isolated polypeptide encoded by polynucleotide comprising or consisting of nucleotides sequences which have a degree of identity to the sequence of SEQ ID NO: 5 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 5. See polynucleotide section herein.

In a fourth aspect, the present invention relates to artificial variants comprising a substitution, deletion, and/or insertion of one or more amino acids of the polypeptide of SEQ ID NO: 6; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

4. Polypeptide Specifically Degrading Capsule of *Klebsiella pneumoniae* Capsular Type K5 Strains The invention provides an isolated polypeptide having degradation activity specific to the capsule of *Klebsiella pneumoniae* capsular type K5 strains, selected from the group consisting of: (a) a polypeptide comprising an amino acid sequence which has at least 60% sequence identity with the mature polypeptide of SEQ ID NO: 8; (b) a polypeptide which is encoded by a polynucleotide which hybridizes under at least high stringency conditions with (i) the polypeptide coding sequence of SEQ ID NO: 7, (ii) a full-length complementary strand of (i); and (c) a polypeptide which is encoded by a polynucleotide having at least 60% sequence identity with the mature polypeptide coding sequence of SEQ ID NO: 7.

In a first aspect, the present invention relates to an isolated polypeptide comprising an amino acid sequence which has a degree of identity to the polypeptide of SEQ ID NO: 8 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K5 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 8.

A polypeptide of the present invention preferably comprises the amino acid sequence of SEQ ID NO: 8 or an allelic variant thereof; or a fragment thereof that has degradation activity specific to the capsule of *Klebsiella pneumoniae* capsular type K5 strains. In a preferred aspect, a polypeptide comprises the amino acid sequence of SEQ ID NO: 8. In another preferred aspect, a polypeptide consists of the amino acid sequence of SEQ ID NO: 8 or an allelic variant thereof; or a fragment thereof that has degradation activity specific to the capsule of *Klebsiella pneumoniae* capsular type K5 strains. In another preferred aspect, a polypeptide consists of the amino acid sequence of SEQ ID NO: 8.

In a second aspect, the present invention relates to an isolated polypeptide having degradation activity specific to the capsule of *Klebsiella pneumoniae* capsular type K5 strains which are encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 7, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 7 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K5 strains. In a preferred aspect, the polypeptide coding sequence is nucleotides as shown in SEQ ID NO: 7. In another preferred aspect, the complementary strand is the full-length complementary strand of the polypeptide coding sequence of SEQ ID NO: 7.

In a third aspect, the present invention relates to an isolated polypeptide encoded by polynucleotide comprising or consisting of nucleotide sequences which have a degree of identity to the sequence of SEQ ID NO: 7 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 7. See polynucleotide section herein.

In a fourth aspect, the present invention relates to artificial variants comprising a substitution, deletion, and/or insertion of one or more amino acids of the polypeptide of SEQ ID NO: 8; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

5. Polypeptide Specifically Degrading Capsule of *Klebsiella pneumoniae* Capsular Type K7 Strains The invention provides an isolated polypeptide having degradation activity specific to the capsule of *Klebsiella pneumoniae* capsular type K7 strains, selected from the group consisting of: (a) a polypeptide comprising an amino acid sequence which has at least 60% sequence identity with the mature polypeptide of SEQ ID NO: 10; (b) a polypeptide which is encoded by a polynucleotide which hybridizes under at least high stringency conditions with (i) the polypeptide coding sequence of SEQ ID NO: 9, (ii) a full-length complementary strand of (i); and (c) a polypeptide which is encoded by a polynucleotide having at least 60% sequence identity with the mature polypeptide coding sequence of SEQ ID NO: 9.

In a first aspect, the present invention relates to an isolated polypeptides comprising an amino acid sequence which has a degree of identity to the polypeptide of SEQ ID NO: 10 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K7 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 10.

A polypeptide of the present invention preferably comprises the amino acid sequence of SEQ ID NO: 10 or an allelic variant thereof; or a fragment thereof that has degradation activity specific to the capsule of *Klebsiella pneumoniae* capsular type K7 strains. In a preferred aspect, a polypeptide comprises the amino acid sequence of SEQ ID NO: 10. In another preferred aspect, a polypeptide consists of the amino acid sequence of SEQ ID NO: 10 or an allelic variant thereof; or a fragment thereof that has degradation activity specific to the capsule of *Klebsiella pneumoniae* capsular type K7 strains. In another preferred aspect, a polypeptide consists of the amino acid sequence of SEQ ID NO: 10.

In a second aspect, the present invention relates to an isolated polypeptides having degradation activity specific to the capsule of *Klebsiella pneumoniae* capsular type K7 strains which are encoded by polynucleotides which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 9, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 9 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K7 strains. In a preferred aspect, the polypeptide coding sequence is nucleotides as shown in SEQ ID NO: 9. In another preferred aspect, the complementary strand is the full-length complementary strand of the polypeptide coding sequence of SEQ ID NO: 9.

In a third aspect, the present invention relates to an isolated polypeptides encoded by polynucleotide comprising or consisting of nucleotide sequences which have a degree of identity to the sequence of SEQ ID NO: 9 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 9. See polynucleotide section herein.

In a fourth aspect, the present invention relates to artificial variants comprising a substitution, deletion, and/or insertion of one or more amino acids of the polypeptide of SEQ ID NO: 10; or a homologous sequence thereof. Preferably, amino acid changes are of a minor nature, that is conservative amino acid substitutions or insertions that do not significantly affect the folding and/or activity of the protein;

small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

6. Polypeptide Specifically Degrading Capsule of *Klebsiella pneumoniae* Capsular Type K8 Strains The invention provides an isolated polypeptide having degradation activity specific to the capsule of *Klebsiella pneumoniae* capsular type K8 strains, selected from the group consisting of: (a) a polypeptide comprising an amino acid sequence which has at least 60% sequence identity with the mature polypeptide of SEQ ID NO: 12; (b) a polypeptide which is encoded by a polynucleotide which hybridizes under at least high stringency conditions with (i) the polypeptide coding sequence of SEQ ID NO: 11, (ii) a full-length complementary strand of (i); and (c) a polypeptide which is encoded by a polynucleotide having at least 60% sequence identity with the mature polypeptide coding sequence of SEQ ID NO: 11.

In a first aspect, the present invention relates to an isolated polypeptides comprising an amino acid sequence which has a degree of identity to the polypeptide of SEQ ID NO: 12 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K8 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 12.

A polypeptide of the present invention preferably comprises the amino acid sequence of SEQ ID NO: 12 or an allelic variant thereof; or a fragment thereof that has degradation activity specific to the capsule of *Klebsiella pneumoniae* capsular type K8 strains. In a preferred aspect, a polypeptide comprises the amino acid sequence of SEQ ID NO: 12. In another preferred aspect, a polypeptide consists of the amino acid sequence of SEQ ID NO: 12 or an allelic variant thereof; or a fragment thereof that has degradation activity specific to the capsule of *Klebsiella pneumoniae* capsular type K8 strains. In another preferred aspect, a polypeptide consists of the amino acid sequence of SEQ ID NO: 12.

In a second aspect, the present invention relates to isolated polypeptides having degradation activity specific to the capsule of *Klebsiella pneumoniae* capsular type K8 strains which are encoded by polynucleotides which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 11, (ii) a subsequence of (i), or (iii) a complementary strand of (i) or, (ii) (J. Sambrook, E. F. Fritsch, and T, Maniatis, 1989, *Molecular Cloning, A Laboratory Manual,* 2d edition, Cold Spring Harbor, N.Y.). A subsequence of the polypeptide coding sequence of SEQ ID NO: 11 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K8 strains. In a preferred aspect, the polypeptide coding sequence is nucleotides as shown in SEQ ID NO: 11. In another preferred aspect, the complementary strand is the full-length complementary strand of the polypeptide coding sequence of SEQ ID NO: 11.

In a third aspect, the present invention relates to isolated polypeptides encoded by polynucleotides comprising or consisting of nucleotide sequences which have a degree of identity to the sequence of SEQ ID NO: 11 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 11. See polynucleotide section herein.

In a fourth aspect, the present invention relates to artificial variants comprising a substitution, deletion, and/or insertion of one or more amino acids of the polypeptide of SEQ ID NO: 12; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

7. Polypeptide Specifically Degrading Capsule of *Klebsiella pneumoniae* Capsular Type K9 Strains The invention provides an isolated polypeptide having degradation activity specific to the capsule of *Klebsiella pneumoniae* capsular type K9 strains, selected from the group consisting of: (a) a polypeptide comprising an amino acid sequence which has at least 60% sequence identity with the mature polypeptide of SEQ ID NO: 14; (b) a polypeptide which is encoded by a polynucleotide which hybridizes under at least high stringency conditions with (i) the polypeptide coding sequence of SEQ ID NO: 13, (ii) a full-length complementary strand of (i); and (c) a polypeptide which is encoded by a polynucleotide having at least 60% sequence identity with the mature polypeptide coding sequence of SEQ ID NO: 13.

In a first aspect, the present invention relates to isolated polypeptides comprising an amino acid sequence which has a degree of identity to the polypeptide of SEQ ID NO: 14 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K9 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 14.

A polypeptide of the present invention preferably comprises the amino acid sequence of SEQ ID NO: 14 or an allelic variant thereof; or a fragment thereof that has degradation activity specific to the capsule of *Klebsiella pneumoniae* capsular type K9 strains. In a preferred aspect, a polypeptide comprises the amino acid sequence of SEQ ID NO: 14. In another preferred aspect, a polypeptide consists of the amino acid sequence of SEQ ID NO: 14 or an allelic variant thereof; or a fragment thereof that has degradation activity specific to the capsule of *Klebsiella pneumoniae* capsular type K9 strains. In another preferred aspect, a polypeptide consists of the amino acid sequence of SEQ ID NO: 14.

In a second aspect, the present invention relates to isolated polypeptides having degradation activity specific to the capsule of *Klebsiella pneumoniae* capsular type K9 strains which are encoded by polynucleotides which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 13, (ii) a subsequence of (i), or (iii) a complementary strand of (i) or (ii) (J. Sambrook, E. F. Fritsch, and T, Maniatis, 1989, *Molecular Cloning, A Laboratory Manual,* 2d edition, Cold Spring Harbor, N.Y.). A subsequence of the polypeptide coding sequence of SEQ ID NO: 13 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K9 strains. In a preferred aspect, the polypeptide coding sequence is nucleotides as shown in SEQ ID NO: 13. In another preferred aspect, the complementary strand is the full-length complementary strand of the polypeptide coding sequence of SEQ ID NO: 13.

In a third aspect, the present invention relates to isolated polypeptides encoded by polynucleotides comprising or consisting of nucleotide sequences which have a degree of identity to the sequence of SEQ ID NO: 13 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 13. See polynucleotide section herein.

In a fourth aspect, the present invention relates to artificial variants comprising a substitution, deletion, and/or insertion of one or more amino acids of the polypeptide of SEQ ID NO: 14; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

8. Polypeptide Specifically Degrading Capsule of *Klebsiella pneumoniae* Capsular Type K10 Strains The invention provides an isolated polypeptide having degradation activity specific to the capsule of *Klebsiella pneumoniae* capsular type K10 strains, selected from the group consisting of: (a) a polypeptide comprising an amino acid sequence which has at least 60% sequence identity with the mature polypeptide of SEQ ID NO: 16; (b) a polypeptide which is encoded by a polynucleotide which hybridizes under at least high stringency conditions with (i) the polypeptide coding sequence of SEQ ID NO: 15, (ii) a full-length complementary strand of (i); and (c) a polypeptide which is encoded by a polynucleotide having at least 60% sequence identity with the mature polypeptide coding sequence of SEQ ID NO: 15.

In a first aspect, the present invention relates to isolated polypeptides comprising an amino acid sequence which has a degree of identity to the polypeptide of SEQ ID NO: 16 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K10 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 16.

A polypeptide of the present invention preferably comprises the amino acid sequence of SEQ ID NO: 16 or an allelic variant thereof; or a fragment thereof that has degradation activity specific to the capsule of *Klebsiella pneumoniae* capsular type K10 strains. In a preferred aspect, a polypeptide comprises the amino acid sequence of SEQ ID NO: 16. In another preferred aspect, a polypeptide consists of the amino acid sequence of SEQ ID NO: 16 or an allelic variant thereof; or a fragment thereof that has degradation activity specific to the capsule of *Klebsiella pneumoniae* capsular type K10 strains. In another preferred aspect, a polypeptide consists of the amino acid sequence of SEQ ID NO: 16.

In a second aspect, the present invention relates to isolated polypeptides having degradation activity specific to the capsule of *Klebsiella pneumoniae* capsular type K10 strains which are encoded by polynucleotides which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 15, (ii) a subsequence of (i), or (iii) a complementary strand of (i) or (ii) (J. Sambrook, E. F. Fritsch, and T, Maniatis, 1989, *Molecular Cloning, A Laboratory Manual,* 2d edition, Cold Spring Harbor, N.Y.). A subsequence of the polypeptide coding sequence of SEQ ID NO: 15 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K10 strains. In a preferred aspect, the polypeptide coding sequence is nucleotides as shown in SEQ ID NO: 15. In another preferred aspect, the complementary strand is the full-length complementary strand of the polypeptide coding sequence of SEQ ID NO: 15.

In a third aspect, the present invention relates to isolated polypeptides encoded by polynucleotides comprising or consisting of nucleotide sequences which have a degree of identity to the sequence of SEQ ID NO: 15 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 15. See polynucleotide section herein.

In a fourth aspect, the present invention relates to artificial variants comprising a substitution, deletion, and/or insertion of one or more amino acids of the polypeptide of SEQ ID NO: 16; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

9. Polypeptide Specifically Degrading Capsule of *Klebsiella pneumoniae* Capsular Type K11 Strains The invention provides an isolated polypeptide having degradation activity specific to the capsule of *Klebsiella pneumoniae* capsular type K11 strains, selected from the group consisting of: (a) a polypeptide comprising an amino acid sequence which has at least 60% sequence identity with the mature polypeptide of SEQ ID NO: 18; (b) a polypeptide which is encoded by a polynucleotide which hybridizes under at least high stringency conditions with (i) the polypeptide coding sequence of SEQ ID NO: 17, (ii) a full-length complementary strand of (i); and (c) a polypeptide which is encoded by a polynucleotide having at least 60% sequence identity with the mature polypeptide coding sequence of SEQ ID NO: 17.

In a first aspect, the present invention relates to isolated polypeptides comprising an amino acid sequence which has a degree of identity to the polypeptide of SEQ ID NO: 18 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K11 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 18.

A polypeptide of the present invention preferably comprises the amino acid sequence of SEQ ID NO: 18 or an allelic variant thereof; or a fragment thereof that has degradation activity specific to the capsule of *Klebsiella pneumoniae* capsular type K11 strains. In a preferred aspect, a polypeptide comprises the amino acid sequence of SEQ ID NO: 18. In another preferred aspect, a polypeptide consists of the amino acid sequence of SEQ ID NO: 18 or an allelic variant thereof; or a fragment thereof that has degradation activity specific to the capsule of *Klebsiella pneumoniae* capsular type K11 strains. In another preferred aspect, a polypeptide consists of the amino acid sequence of SEQ ID NO: 18.

In a second aspect, the present invention relates to isolated polypeptides having degradation activity specific to the capsule of *Klebsiella pneumoniae* capsular type K11 strains which are encoded by polynucleotides which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 17, (ii) a subsequence of (i), or (iii) a complementary strand of (i) or (ii) (J. Sambrook, E. F. Fritsch, and T, Maniatis, 1989, *Molecular Cloning, A Laboratory Manual,* 2d edition, Cold Spring Harbor, N.Y.). A subsequence of the polypeptide coding sequence of SEQ ID NO: 17 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K11 strains. In a preferred aspect, the polypeptide coding sequence is nucleotides as shown in SEQ ID NO: 17. In another preferred aspect, the complementary strand is the full-length complementary strand of the polypeptide coding sequence of SEQ ID NO: 17.

In a third aspect, the present invention relates to isolated polypeptides encoded by polynucleotides comprising or consisting of nucleotide sequences which have a degree of identity to the sequence of SEQ ID NO: 17 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 17. See polynucleotide section herein.

In a fourth aspect, the present invention relates to artificial variants comprising a substitution, deletion, and/or insertion of one or more amino acids of the polypeptide of SEQ ID NO: 18; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

10. Polypeptide Specifically Degrading Capsule of *Klebsiella pneumoniae* Capsular Type K17 Strains The invention provides an isolated polypeptide having degradation activity specific to the capsule of *Klebsiella pneumoniae* capsular type K17 strains, selected from the group consisting of: (a) a polypeptide comprising an amino acid sequence which has at least 60% sequence identity with the mature polypeptide of SEQ ID NO: 20; (b) a polypeptide which is encoded by a polynucleotide which hybridizes under at least high stringency conditions with (i) the polypeptide coding sequence of SEQ ID NO: 19, (ii) a full-length complementary strand of (i); and (c) a polypeptide which is encoded by a polynucleotide having at least 60% sequence identity with the mature polypeptide coding sequence of SEQ ID NO: 19.

In a first aspect, the present invention relates to isolated polypeptides comprising an amino acid sequence which has a degree of identity to the polypeptide of SEQ ID NO: 20 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K17 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 20.

A polypeptide of the present invention preferably comprises the amino acid sequence of SEQ ID NO: 20 or an allelic variant thereof; or a fragment thereof that has degradation activity specific to the capsule of *Klebsiella pneumoniae* capsular type K17 strains. In a preferred aspect, a polypeptide comprises the amino acid sequence of SEQ ID NO: 20. In another preferred aspect, a polypeptide consists of the amino acid sequence of SEQ ID NO: 20 or an allelic variant thereof; or a fragment thereof that has degradation activity specific to the capsule of *Klebsiella pneumoniae* capsular type K17 strains. In another preferred aspect, a polypeptide consists of the amino acid sequence of SEQ ID NO: 20.

In a second aspect, the present invention relates to isolated polypeptides having degradation activity specific to the capsule of *Klebsiella pneumoniae* capsular type K17 strains which are encoded by polynucleotides which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 19, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 19 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K17 strains. In a preferred aspect, the polypeptide coding sequence is nucleotides as shown in SEQ ID NO: 19. In another preferred aspect, the complementary strand is the full-length complementary strand of the polypeptide coding sequence of SEQ ID NO: 19.

In a third aspect, the present invention relates to isolated polypeptides encoded by polynucleotides comprising or consisting of nucleotide sequences which have a degree of identity to the sequence of SEQ ID NO: 19 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 19. See polynucleotide section herein.

In a fourth aspect, the present invention relates to artificial variants comprising a substitution, deletion, and/or insertion of one or more amino acids of the polypeptide of SEQ ID NO: 20; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

11. Polypeptide Specifically Degrading Capsule of *Klebsiella pneumoniae* Capsular Type K19 Strains The invention provides an isolated polypeptide having degradation activity specific to the capsule of *Klebsiella pneumoniae* capsular type K19 strains, selected from the group consisting of: (a) a polypeptide comprising an amino acid sequence which has at least 60% sequence identity with the mature polypeptide of SEQ ID NO: 22; (b) a polypeptide which is encoded by a polynucleotide which hybridizes under at least high stringency conditions with (i) the polypeptide coding sequence of SEQ ID NO: 21, (ii) a full-length complementary strand of (i); and (c) a polypeptide which is encoded by a polynucleotide having at least 60% sequence identity with the mature polypeptide coding sequence of SEQ ID NO: 21.

In a first aspect, the present invention relates to isolated polypeptides comprising an amino acid sequence which has a degree of identity to the polypeptide of SEQ ID NO: 22 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K19 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 22.

A polypeptide of the present invention preferably comprises the amino acid sequence of SEQ ID NO: 22 or an allelic variant thereof; or a fragment thereof that has degradation activity specific to the capsule of *Klebsiella pneumoniae* capsular type K19 strains. In a preferred aspect, a polypeptide comprises the amino acid sequence of SEQ ID NO: 22. In another preferred aspect, a polypeptide consists of the amino acid sequence of SEQ ID NO: 22 or an allelic variant thereof; or a fragment thereof that has degradation activity specific to the capsule of *Klebsiella pneumoniae* capsular type K19 strains. In another preferred aspect, a polypeptide consists of the amino acid sequence of SEQ ID NO: 22.

In a second aspect, the present invention relates to isolated polypeptides having degradation activity specific to the capsule of *Klebsiella pneumoniae* capsular type K19 strains which are encoded by polynucleotides which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 21, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 21 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K19 strains. In a preferred aspect, the polypeptide coding sequence is nucleotides as shown in SEQ ID NO: 21. In another preferred aspect, the complementary strand is the full-length complementary strand of the polypeptide coding sequence of SEQ ID NO: 21.

In a third aspect, the present invention relates to isolated polypeptides encoded by polynucleotides comprising or consisting of nucleotide sequences which have a degree of identity to the sequence of SEQ ID NO: 21 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 21. See polynucleotide section herein.

In a fourth aspect, the present invention relates to artificial variants comprising a substitution, deletion, and/or insertion of one or more amino acids of the polypeptide of SEQ ID NO: 22; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

12. Polypeptide Specifically Degrading Capsule of *Klebsiella pneumoniae* Capsular Type K21 Strains The invention provides an isolated polypeptide having degradation activity specific to the capsule of *Klebsiella pneumoniae* capsular type K21 strains, selected from the group consisting of: (a) a polypeptide comprising an amino acid sequence which has at least 60% sequence identity with the mature polypeptide of SEQ ID NO: 24; (b) a polypeptide which is encoded by a polynucleotide which hybridizes under at least high stringency conditions with (i) the polypeptide coding sequence of SEQ ID NO: 23, (ii) a full-length complementary strand of (i); and (c) a polypeptide which is encoded by a polynucleotide having at least 60% sequence identity with the mature polypeptide coding sequence of SEQ ID NO: 23.

In a first aspect, the present invention relates to isolated polypeptides comprising an amino acid sequence which has a degree of identity to the polypeptide of SEQ ID NO: 24 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K21 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 24.

A polypeptide of the present invention preferably comprises the amino acid sequence of SEQ ID NO: 24 or an allelic variant thereof; or a fragment thereof that has degradation activity specific to the capsule of *Klebsiella pneumoniae* capsular type K21 strains. In a preferred aspect, a polypeptide comprises the amino acid sequence of SEQ ID NO: 24. In another preferred aspect, a polypeptide consists of the amino acid sequence of SEQ ID NO: 24 or an allelic variant thereof; or a fragment thereof that has degradation activity specific to the capsule of *Klebsiella pneumoniae* capsular type K21 strains. In another preferred aspect, a polypeptide consists of the amino acid sequence of SEQ ID NO: 24.

In a second aspect, the present invention relates to isolated polypeptides having degradation activity specific to the capsule of *Klebsiella pneumoniae* capsular type K21 strains which are encoded by polynucleotides which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 23, (ii) a subsequence of (i), or (iii) a complementary strand of (i) or (ii) (J. Sambrook, E. F. Fritsch, and T, Maniatis, 1989, *Molecular Cloning, A Laboratory Manual,* 2d edition, Cold Spring Harbor, N.Y.). A subsequence of the polypeptide coding sequence of SEQ ID NO: 23 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K21 strains. In a preferred aspect, the polypeptide coding sequence is nucleotides as shown in SEQ ID NO: 23. In another preferred aspect, the complementary strand is the full-length complementary strand of the polypeptide coding sequence of SEQ ID NO: 23.

In a third aspect, the present invention relates to isolated polypeptides encoded by polynucleotides comprising or consisting of nucleotide sequences which have a degree of identity to the sequence of SEQ ID NO: 23 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 23. See polynucleotide section herein.

In a fourth aspect, the present invention relates to artificial variants comprising a substitution, deletion, and/or insertion of one or more amino acids of the polypeptide of SEQ ID NO: 24; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

13. Polypeptide Specifically Degrading Capsule of *Klebsiella pneumoniae* Capsular Type K22 Strains The invention provides an isolated polypeptide having degradation activity specific to the capsule of *Klebsiella*

*pneumoniae* capsular type K22 strains, selected from the group consisting of: (a) a polypeptide comprising an amino acid sequence which has at least 60% sequence identity with the mature polypeptide of SEQ ID NO: 26; (b) a polypeptide which is encoded by a polynucleotide which hybridizes under at least high stringency conditions with (i) the polypeptide coding sequence of SEQ ID NO: 25, (ii) a full-length complementary strand of (i); and (c) a polypeptide which is encoded by a polynucleotide having at least 60% sequence identity with the mature polypeptide coding sequence of SEQ ID NO: 25.

In a first aspect, the present invention relates to isolated polypeptides comprising an amino acid sequence which has a degree of identity to the polypeptide of SEQ ID NO: 26 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K22 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 26.

A polypeptide of the present invention preferably comprises the amino acid sequence of SEQ ID NO: 26 or an allelic variant thereof; or a fragment thereof that has degradation activity specific to the capsule of *Klebsiella pneumoniae* capsular type K22 strains. In a preferred aspect, a polypeptide comprises the amino acid sequence of SEQ ID NO: 26. In another preferred aspect, a polypeptide consists of the amino acid sequence of SEQ ID NO: 26 or an allelic variant thereof; or a fragment thereof that has degradation activity specific to the capsule of *Klebsiella pneumoniae* capsular type K22 strains. In another preferred aspect, a polypeptide consists of the amino acid sequence of SEQ ID NO: 26.

In a second aspect, the present invention relates to isolated polypeptides having degradation activity specific to the capsule of *Klebsiella pneumoniae* capsular type K22 strains which are encoded by polynucleotides which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 25, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 25 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K22 strains. In a preferred aspect, the polypeptide coding sequence is nucleotides as shown in SEQ ID NO: 25. In another preferred aspect, the complementary strand is the full-length complementary strand of the polypeptide coding sequence of SEQ ID NO: 25.

In a third aspect, the present invention relates to an isolated polypeptide encoded by polynucleotide comprising or consisting of nucleotide sequence which have a degree of identity to the sequence of SEQ ID NO: 25 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 25. See polynucleotide section herein.

In a fourth aspect, the present invention relates to artificial variants comprising a substitution, deletion, and/or insertion of one or more amino acids of the polypeptide of SEQ ID NO: 26; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

14. Polypeptide Specifically Degrading Capsule of *Klebsiella pneumoniae* Capsular Type K24 Strains The invention provides an isolated polypeptide having degradation activity specific to the capsule of *Klebsiella pneumoniae* capsular type K24 strains, selected from the group consisting of: (a) a polypeptide comprising an amino acid sequence which has at least 60% sequence identity with the mature polypeptide of SEQ ID NO: 28; (b) a polypeptide which is encoded by a polynucleotide which hybridizes under at least high stringency conditions with (i) the polypeptide coding sequence of SEQ ID NO: 27, (ii) a full-length complementary strand of (i); and (c) a polypeptide which is encoded by a polynucleotide having at least 60% sequence identity with the mature polypeptide coding sequence of SEQ ID NO: 27.

In a first aspect, the present invention relates to isolated polypeptides comprising an amino acid sequence which has a degree of identity to the polypeptide of SEQ ID NO: 28 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K24 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 28.

A polypeptide of the present invention preferably comprises the amino acid sequence of SEQ ID NO: 28 or an allelic variant thereof; or a fragment thereof that has degradation activity specific to the capsule of *Klebsiella pneumoniae* capsular type K24 strains. In a preferred aspect, a polypeptide comprises the amino acid sequence of SEQ ID NO: 28. In another preferred aspect, a polypeptide consists of the amino acid sequence of SEQ ID NO: 28 or an allelic variant thereof; or a fragment thereof that has degradation activity specific to the capsule of *Klebsiella pneumoniae* capsular type K24 strains. In another preferred aspect, a polypeptide consists of the amino acid sequence of SEQ ID NO: 28.

In a second aspect, the present invention relates to isolated polypeptides having degradation activity specific to the capsule of *Klebsiella pneumoniae* capsular type K24 strains which are encoded by polynucleotides which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 27, (ii) a subsequence of (i), or (iv) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 27 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K24 strains. In a preferred aspect, the polypeptide coding sequence is nucleotides as shown in SEQ ID NO: 27. In another preferred aspect, the complementary strand is the full-length complementary strand of the polypeptide coding sequence of SEQ ID NO: 27.

In a third aspect, the present invention relates to an isolated polypeptide encoded by polynucleotide comprising or consisting of nucleotide sequence which have a degree of identity to the sequence of SEQ ID NO: 27 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 27. See polynucleotide section herein.

In a fourth aspect, the present invention relates to artificial variants comprising a substitution, deletion, and/or insertion of one or more amino acids of the polypeptide of SEQ ID NO: 28; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

15. Polypeptide Specifically Degrading Capsule of *Klebsiella pneumoniae* Capsular Type K25 Strains The invention provides an isolated polypeptide having degradation activity specific to the capsule of *Klebsiella pneumoniae* capsular type K25 strains, selected from the group consisting of: (a) a polypeptide comprising an amino acid sequence which has at least 60% sequence identity with the mature polypeptide of SEQ ID NO: 30; (b) a polypeptide which is encoded by a polynucleotide which hybridizes under at least high stringency conditions with (i) the polypeptide coding sequence of SEQ ID NO: 29, (ii) a full-length complementary strand of (i); and (c) a polypeptide which is encoded by a polynucleotide having at least 60% sequence identity with the mature polypeptide coding sequence of SEQ ID NO: 29.

In a first aspect, the present invention relates to isolated polypeptides comprising an amino acid sequence which has a degree of identity to the polypeptide of SEQ ID NO: 30 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K25 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 30.

A polypeptide of the present invention preferably comprises the amino acid sequence of SEQ ID NO: 30 or an allelic variant thereof; or a fragment thereof that has degradation activity specific to the capsule of *Klebsiella pneumoniae* capsular type K25 strains. In a preferred aspect, a polypeptide comprises the amino acid sequence of SEQ ID NO: 30. In another preferred aspect, a polypeptide consists of the amino acid sequence of SEQ ID NO: 30 or an allelic variant thereof; or a fragment thereof that has degradation activity specific to the capsule of *Klebsiella pneumoniae* capsular type K25 strains. In another preferred aspect, a polypeptide consists of the amino acid sequence of SEQ ID NO: 30.

In a second aspect, the present invention relates to an isolated polypeptide having degradation activity specific to the capsule of *Klebsiella pneumoniae* capsular type K25 strains which are encoded by a polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 29, (ii) a subsequence of (i), or (iv) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 29 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K25 strains. In a preferred aspect, the polypeptide coding sequence is nucleotides as shown in SEQ ID NO: 29. In another preferred aspect, the complementary strand is the full-length complementary strand of the polypeptide coding sequence of SEQ ID NO: 29.

In a third aspect, the present invention relates to isolated polypeptides encoded by polynucleotide comprising or consisting of nucleotide sequences which have a degree of identity to the sequence of SEQ ID NO: 29 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 29. See polynucleotide section herein.

In a fourth aspect, the present invention relates to artificial variants comprising a substitution, deletion, and/or insertion of one or more amino acids of the polypeptide of SEQ ID NO: 30; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

16. Polypeptide Specifically Degrading Capsule of *Klebsiella pneumoniae* Capsular Type K26 Strains The invention provides an isolated polypeptide having degradation activity specific to the capsule of *Klebsiella pneumoniae* capsular type K26 strains, selected from the group consisting of: (a) a polypeptide comprising an amino acid sequence which has at least 60% sequence identity with the mature polypeptide of SEQ ID NO: 32; (b) a polypeptide which is encoded by a polynucleotide which hybridizes under at least high stringency conditions with (i) the polypeptide coding sequence of SEQ ID NO: 31, (ii) the cDNA sequence contained in the polypeptide coding sequence of SEQ ID NO: 31, or (iii) a full-length complementary strand of (i) or (ii); and (c) a polypeptide which is encoded by a polynucleotide having at least 60% sequence identity with the mature polypeptide coding sequence of SEQ ID NO: 31.

In a first aspect, the present invention relates to isolated polypeptides comprising an amino acid sequence which has a degree of identity to the polypeptide of SEQ ID NO: 32 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K26 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 32.

A polypeptide of the present invention preferably comprises the amino acid sequence of SEQ ID NO: 32 or an allelic variant thereof; or a fragment thereof that has degradation activity specific to the capsule of *Klebsiella pneumoniae* capsular type K26 strains. In a preferred aspect, a polypeptide comprises the amino acid sequence of SEQ ID NO: 32. In another preferred aspect, a polypeptide consists of the amino acid sequence of SEQ ID NO: 32 or an allelic variant thereof; or a fragment thereof that has degradation activity specific to the capsule of *Klebsiella pneumoniae* capsular type K26 strains. In another preferred aspect, a polypeptide consists of the amino acid sequence of SEQ ID NO: 32.

In a second aspect, the present invention relates to isolated polypeptides having degradation activity specific to the capsule of *Klebsiella pneumoniae* capsular type K26 strains which are encoded by polynucleotides which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 31, (ii) the cDNA sequence contained in the polypeptide coding sequence of SEQ ID NO: 31, (iii) a subsequence of (i) or (ii), or (iv) a complementary strand of (i), (ii), or (iii) (J. Sambrook, E. F. Fritsch, and T, Maniatis, 1989, *Molecular Cloning, A Laboratory Manual,* 2d edition, Cold Spring Harbor, N.Y.). A subsequence of the polypeptide coding sequence of SEQ ID NO: 31 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K26 strains. In a preferred aspect, the polypeptide coding sequence is nucleotides as shown in SEQ ID NO: 31. In another preferred aspect, the complementary strand is the full-length complementary strand of the polypeptide coding sequence of SEQ ID NO: 31.

In a third aspect, the present invention relates to an isolated polypeptide encoded by polynucleotide comprising or consisting of nucleotide sequences which have a degree of identity to the sequence of SEQ ID NO: 31 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 31. See polynucleotide section herein.

In a fourth aspect, the present invention relates to artificial variants comprising a substitution, deletion, and/or insertion of one or more amino acids of the polypeptide of SEQ ID NO: 32; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

17. Polypeptide Specifically Degrading Capsule of *Klebsiella pneumoniae* Capsular Type K27 Strains The invention provides an isolated polypeptide having degradation activity specific to the capsule of *Klebsiella pneumoniae* capsular type K27 strains, selected from the group consisting of: (a) a polypeptide comprising an amino acid sequence which has at least 60% sequence identity with the mature polypeptide of SEQ ID NO: 34; (b) a polypeptide which is encoded by a polynucleotide which hybridizes under at least high stringency conditions with (i) the polypeptide coding sequence of SEQ ID NO: 33, (ii) a full-length complementary strand of (i); and (c) a polypeptide which is encoded by a polynucleotide having at least 60% sequence identity with the mature polypeptide coding sequence of SEQ ID NO: 33.

In a first aspect, the present invention relates to an isolated polypeptide comprising an amino acid sequence which has a degree of identity to the polypeptide of SEQ ID NO: 34 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K27 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 34.

A polypeptide of the present invention preferably comprises the amino acid sequence of SEQ ID NO: 34 or an allelic variant thereof; or a fragment thereof that has degradation activity specific to the capsule of Klebsiella pneumoniae capsular type K27 strains. In a preferred aspect, a polypeptide comprises the amino acid sequence of SEQ ID NO: 34. In another preferred aspect, a polypeptide consists of the amino acid sequence of SEQ ID NO: 34 or an allelic variant thereof; or a fragment thereof that has degradation activity specific to the capsule of Klebsiella pneumoniae capsular type K27 strains. In another preferred aspect, a polypeptide consists of the amino acid sequence of SEQ ID NO: 34.

In a second aspect, the present invention relates to an isolated polypeptides having degradation activity specific to the capsule of Klebsiella pneumoniae capsular type K27 strains which are encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 33, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 33 contains at least 100 contiguous nucleotides or preferably at least 200 contiguous nucleotides. Moreover, the subsequence may encode a polypeptide fragment which has degradation activity specific to the capsule of Klebsiella pneumoniae capsular type K27 strains. In a preferred aspect, the polypeptide coding sequence is nucleotides as shown in SEQ ID NO: 33. In another preferred aspect, the complementary strand is the full-length complementary strand of the polypeptide coding sequence of SEQ ID NO: 33.

In a third aspect, the present invention relates to an isolated polypeptides encoded by polynucleotide comprising or consisting of nucleotide sequences which have a degree of identity to the sequence of SEQ ID NO: 33 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 33. See polynucleotide section herein.

In a fourth aspect, the present invention relates to artificial variants comprising a substitution, deletion, and/or insertion of one or more amino acids of the polypeptide of SEQ ID NO: 34; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

18. Polypeptide Specifically Degrading Capsule of Klebsiella pneumoniae Capsular Type K28 Strains The invention provides an isolated polypeptide having degradation activity specific to the capsule of Klebsiella pneumoniae capsular type K28 strains, selected from the group consisting of: (a) a polypeptide comprising an amino acid sequence which has at least 60% sequence identity with the mature polypeptide of SEQ ID NO: 36; (b) a polypeptide which is encoded by a polynucleotide which hybridizes under at least high stringency conditions with (i) the polypeptide coding sequence of SEQ ID NO: 35, (ii) a full-length complementary strand of (i); and (c) a polypeptide which is encoded by a polynucleotide having at least 60% sequence identity with the mature polypeptide coding sequence of SEQ ID NO: 35.

In a first aspect, the present invention relates to an isolated polypeptide comprising an amino acid sequence which has a degree of identity to the polypeptide of SEQ ID NO: 36 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of Klebsiella pneumoniae capsular type K28 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 36.

A polypeptide of the present invention preferably comprises the amino acid sequence of SEQ ID NO: 36 or an allelic variant thereof; or a fragment thereof that has degradation activity specific to the capsule of Klebsiella pneumoniae capsular type K28 strains. In a preferred aspect, a polypeptide comprises the amino acid sequence of SEQ ID NO: 36. In another preferred aspect, a polypeptide consists of the amino acid sequence of SEQ ID NO: 36 or an allelic variant thereof; or a fragment thereof that has degradation activity specific to the capsule of Klebsiella pneumoniae capsular type K28 strains. In another preferred aspect, a polypeptide consists of the amino acid sequence of SEQ ID NO: 36.

In a second aspect, the present invention relates to an isolated polypeptide having degradation activity specific to the capsule of Klebsiella pneumoniae capsular type K28 strains which are encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 35, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 35 contains at least 100 contiguous nucleotides or preferably at least 200 contiguous nucleotides. Moreover, the subsequence may encode a polypeptide fragment which has degradation activity specific to the capsule of Klebsiella pneumoniae capsular type K28 strains. In a preferred aspect, the polypeptide coding sequence is nucleotides as shown in SEQ ID NO: 35. In another preferred aspect, the complementary strand is the full-length complementary strand of the polypeptide coding sequence of SEQ ID NO: 35.

In a third aspect, the present invention relates to an isolated polypeptides encoded by polynucleotide comprising or consisting of nucleotide sequences which have a degree of identity to the sequence of SEQ ID NO: 35 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 35. See polynucleotide section herein.

In a fourth aspect, the present invention relates to artificial variants comprising a substitution, deletion, and/or insertion of one or more amino acids of the polypeptide of SEQ ID NO: 36; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

19. Polypeptide Specifically Degrading Capsule of *Klebsiella pneumoniae* Capsular Type K30 and/or K69 Strains The invention provides an isolated polypeptide having degradation activity specific to the capsule of *Klebsiella pneumoniae* capsular type K30 and/or K69 strains, selected from the group consisting of: (a) a polypeptide comprising an amino acid sequence which has at least 60% sequence identity with the mature polypeptide of SEQ ID NO: 38; (b) a polypeptide which is encoded by a polynucleotide which hybridizes under at least high stringency conditions with (i) the polypeptide coding sequence of SEQ ID NO: 37, (ii) a full-length complementary strand of (i); and (c) a polypeptide which is encoded by a polynucleotide having at least 60% sequence identity with the mature polypeptide coding sequence of SEQ ID NO: 37.

In a first aspect, the present invention relates to an isolated polypeptides comprising an amino acid sequence which has a degree of identity to the polypeptide of SEQ ID NO: 38 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K30 and/or K69 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 38.

A polypeptide of the present invention preferably comprises the amino acid sequence of SEQ ID NO: 38 or an allelic variant thereof; or a fragment thereof that has degradation activity specific to the capsule of *Klebsiella pneumoniae* capsular type K30 and/or K69 strains. In a preferred aspect, a polypeptide comprises the amino acid sequence of SEQ ID NO: 38. In another preferred aspect, a polypeptide consists of the amino acid sequence of SEQ ID NO: 38 or an allelic variant thereof; or a fragment thereof that has degradation activity specific to the capsule of *Klebsiella pneumoniae* capsular type K30 and/or K69 strains. In another preferred aspect, a polypeptide consists of the amino acid sequence of SEQ ID NO: 38.

In a second aspect, the present invention relates to isolated polypeptides having degradation activity specific to the capsule of *Klebsiella pneumoniae* capsular type K30 and/or K69 strains which are encoded by polynucleotides which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 37, (ii) a subsequence of (i), or (iv) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 37 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K30 and/or K69 strains. In a preferred aspect, the polypeptide coding sequence is nucleotides as shown in SEQ ID NO: 37. In another preferred aspect, the complementary strand is the full-length complementary strand of the polypeptide coding sequence of SEQ ID NO: 37.

In a third aspect, the present invention relates to an isolated polypeptides encoded by polynucleotide comprising or consisting of nucleotide sequences which have a degree of identity to the sequence of SEQ ID NO: 37 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 37. See polynucleotide section herein.

In a fourth aspect, the present invention relates to artificial variants comprising a substitution, deletion, and/or insertion of one or more amino acids of the polypeptide of SEQ ID NO: 38; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

20. Polypeptide Specifically Degrading Capsule of *Klebsiella pneumoniae* Capsular Type K31 Strains The invention provides an isolated polypeptide having degradation activity specific to the capsule of *Klebsiella pneumoniae* capsular type K31 strains, selected from the group consisting of: (a) a polypeptide comprising an amino acid sequence which has at least 60% sequence identity with the mature polypeptide of SEQ ID NO: 40; (b) a polypeptide which is encoded by a polynucleotide which hybridizes under at least high stringency conditions with (i) the polypeptide coding sequence of SEQ ID NO: 39, (ii) a full-length complementary strand of (i)); and (c) a polypeptide which is encoded by a polynucleotide having at least 60% sequence identity with the mature polypeptide coding sequence of SEQ ID NO: 39.

In a first aspect, the present invention relates to an isolated polypeptides comprising an amino acid sequence which has a degree of identity to the polypeptide of SEQ ID NO: 40 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K31 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 40.

A polypeptide of the present invention preferably comprises the amino acid sequence of SEQ ID NO: 40 or an allelic variant thereof; or a fragment thereof that has degradation activity specific to the capsule of *Klebsiella pneumoniae* capsular type K31 strains. In a preferred aspect, a polypeptide comprises the amino acid sequence of SEQ ID NO: 40. In another preferred aspect, a polypeptide consists of the amino acid sequence of SEQ ID NO: 40 or an allelic variant thereof; or a fragment thereof that has degradation activity specific to the capsule of *Klebsiella pneumoniae* capsular type K31 strains. In another preferred aspect, a polypeptide consists of the amino acid sequence of SEQ ID NO: 40.

In a second aspect, the present invention relates to an isolated polypeptides having degradation activity specific to the capsule of *Klebsiella pneumoniae* capsular type K31 strains which are encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 39, (ii) a subsequence of (i), or (iv) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 39 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K31 strains. In a preferred aspect, the polypeptide coding sequence is nucleotides as shown in SEQ ID NO: 39. In another preferred aspect, the complementary strand is the full-length complementary strand of the polypeptide coding sequence of SEQ ID NO: 39.

In a third aspect, the present invention relates to an isolated polypeptides encoded by polynucleotide comprising or consisting of nucleotide sequences which have a degree of identity to the sequence of SEQ ID NO: 39 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 39. See polynucleotide section herein.

In a fourth aspect, the present invention relates to artificial variants comprising a substitution, deletion, and/or insertion of one or more amino acids of the polypeptide of SEQ ID NO: 40; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

21. Polypeptide Specifically Degrading Capsule of *Klebsiella pneumoniae* Capsular Type K33 Strains The invention provides an isolated polypeptide having degradation activity specific to the capsule of *Klebsiella pneumoniae* capsular type K33 strains, selected from the group consisting of: (a) a polypeptide comprising an amino acid sequence which has at least 60% sequence identity with the mature polypeptide of SEQ ID NO: 42; (b) a polypeptide which is encoded by a polynucleotide which hybridizes under at least high stringency conditions with (i) the polypeptide coding sequence of SEQ ID NO: 41, (ii) a full-length complementary strand of (i); and (c) a polypeptide which is encoded by a polynucleotide having at least 60% sequence identity with the mature polypeptide coding sequence of SEQ ID NO: 41.

In a first aspect, the present invention relates to an isolated polypeptides comprising an amino acid sequence which has a degree of identity to the polypeptide of SEQ ID NO: 42 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K33 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 42.

A polypeptide of the present invention preferably comprises the amino acid sequence of SEQ ID NO: 42 or an allelic variant thereof; or a fragment thereof that has degradation activity specific to the capsule of *Klebsiella pneumoniae* capsular type K33 strains. In a preferred aspect, a polypeptide comprises the amino acid sequence of SEQ ID NO: 42. In another preferred aspect, a polypeptide consists of the amino acid sequence of SEQ ID NO: 42 or an allelic variant thereof; or a fragment thereof that has degradation activity specific to the capsule of *Klebsiella pneumoniae* capsular type K33 strains. In another preferred aspect, a polypeptide consists of the amino acid sequence of SEQ ID NO: 42.

In a second aspect, the present invention relates to an isolated polypeptides having degradation activity specific to the capsule of *Klebsiella pneumoniae* capsular type K33 strains which are encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 41, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 41 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K33 strains. In a preferred aspect, the polypeptide coding sequence is nucleotides as shown in SEQ ID NO: 41. In another preferred aspect, the complementary strand is the full-length complementary strand of the polypeptide coding sequence of SEQ ID NO: 41.

In a third aspect, the present invention relates to an isolated polypeptides encoded by polynucleotide comprising or consisting of nucleotide sequences which have a degree of identity to the sequence of SEQ ID NO: 41 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 41. See polynucleotide section herein.

In a fourth aspect, the present invention relates to artificial variants comprising a substitution, deletion, and/or insertion of one or more amino acids of the polypeptide of SEQ ID NO: 42; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

22. Polypeptide Specifically Degrading Capsule of *Klebsiella pneumoniae* Capsular Type K34 Strains The invention provides an isolated polypeptide having degradation activity specific to the capsule of *Klebsiella pneumoniae* capsular type K34 strains, selected from the group consisting of: (a) a polypeptide comprising an amino acid sequence which has at least 60% sequence identity with the mature polypeptide of SEQ ID NO: 44; (b) a polypeptide which is encoded by a polynucleotide which hybridizes under at least high stringency conditions with (i) the polypeptide coding sequence of SEQ ID NO: 43, (ii) a full-length complementary strand of (i); and (c) a polypeptide which is encoded by a polynucleotide having at least 60% sequence identity with the mature polypeptide coding sequence of SEQ ID NO: 43.

In a first aspect, the present invention relates to an isolated polypeptide comprising an amino acid sequence which has a degree of identity to the polypeptide of SEQ ID NO: 44 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K34 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 44.

A polypeptide of the present invention preferably comprises the amino acid sequence of SEQ ID NO: 44 or an allelic variant thereof; or a fragment thereof that has degradation activity specific to the capsule of *Klebsiella pneumoniae* capsular type K34 strains. In a preferred aspect, a polypeptide comprises the amino acid sequence of SEQ ID NO: 44. In another preferred aspect, a polypeptide consists of the amino acid sequence of SEQ ID NO: 44 or an allelic variant thereof; or a fragment thereof that has degradation activity specific to the capsule of *Klebsiella pneumoniae* capsular type K34 strains. In another preferred aspect, a polypeptide consists of the amino acid sequence of SEQ ID NO: 44.

In a second aspect, the present invention relates to an isolated polypeptide having degradation activity specific to the capsule of *Klebsiella pneumoniae* capsular type K34 strains which are encoded by polynucleotides which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 43, (ii) a subsequence of (i) or (ii), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 43 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K34 strains. In a preferred aspect, the polypeptide coding sequence is nucleotides as shown in SEQ ID NO: 43. In another preferred aspect, the complementary strand is the full-length complementary strand of the polypeptide coding sequence of SEQ ID NO: 43.

In a third aspect, the present invention relates to an isolated polypeptides encoded by polynucleotide comprising or consisting of nucleotide sequences which have a degree of identity to the sequence of SEQ ID NO: 43 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 43. See polynucleotide section herein.

In a fourth aspect, the present invention relates to artificial variants comprising a substitution, deletion, and/or insertion of one or more amino acids of the polypeptide of SEQ ID NO: 44; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

23. Polypeptide Specifically Degrading Capsule of *Klebsiella pneumoniae* Capsular Type K35 Strains The invention provides an isolated polypeptide having degradation activity specific to the capsule of *Klebsiella pneumoniae* capsular type K35 strains, selected from the group consisting of: (a) a polypeptide comprising an amino acid sequence which has at least 60% sequence identity with the mature polypeptide of SEQ ID NO: 46; (b) a polypeptide which is encoded by a polynucleotide which hybridizes under at least high stringency conditions with (i) the polypeptide coding sequence of SEQ ID NO: 45, (ii) a full-length complementary strand of (i); and (c) a polypeptide which is encoded by a polynucleotide having at least 60% sequence identity with the mature polypeptide coding sequence of SEQ ID NO: 45.

In a first aspect, the present invention relates to an isolated polypeptides comprising an amino acid sequence which has a degree of identity to the polypeptide of SEQ ID NO: 46 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K35 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 46.

A polypeptide of the present invention preferably comprises the amino acid sequence of SEQ ID NO: 46 or an allelic variant thereof; or a fragment thereof that has degradation activity specific to the capsule of *Klebsiella pneumoniae* capsular type K35 strains. In a preferred aspect, a polypeptide comprises the amino acid sequence of SEQ ID NO: 46. In another preferred aspect, a polypeptide consists of the amino acid sequence of SEQ ID NO: 46 or an allelic variant thereof; or a fragment thereof that has degradation activity specific to the capsule of *Klebsiella pneumoniae* capsular type K35 strains. In another preferred aspect, a polypeptide consists of the amino acid sequence of SEQ ID NO: 46.

In a second aspect, the present invention relates to an isolated polypeptides having degradation activity specific to the capsule of *Klebsiella pneumoniae* capsular type K35 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 45, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 45 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K35 strains. In a preferred aspect, the polypeptide coding sequence is nucleotides as shown in SEQ ID NO: 45. In another preferred aspect, the complementary strand is the full-length complementary strand of the polypeptide coding sequence of SEQ ID NO: 45.

In a third aspect, the present invention relates to an isolated polypeptide encoded by polynucleotide comprising or consisting of nucleotide sequences which have a degree of identity to the sequence of SEQ ID NO: 45 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 45. See polynucleotide section herein.

In a fourth aspect, the present invention relates to artificial variants comprising a substitution, deletion, and/or insertion of one or more amino acids of the polypeptide of SEQ ID NO: 46; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

24. Polypeptide Specifically Degrading Capsule of *Klebsiella pneumoniae* Capsular Type K36 Strains The invention provides an isolated polypeptide having degradation activity specific to the capsule of *Klebsiella pneumoniae* capsular type K36 strains, selected from the group consisting of: (a) a polypeptide comprising an amino acid sequence which has at least 60% sequence identity with the mature polypeptide of SEQ ID NO: 48; (b) a polypeptide which is encoded by a polynucleotide which hybridizes under at least high stringency conditions with (i) the polypeptide coding sequence of SEQ ID NO: 47, (ii) a full-length complementary strand of (i); and (c) a polypeptide which is encoded by a polynucleotide having at least 60% sequence identity with the mature polypeptide coding sequence of SEQ ID NO: 47.

In a first aspect, the present invention relates to an isolated polypeptide comprising an amino acid sequence which has a degree of identity to the polypeptide of SEQ ID NO: 48 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K36 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 48.

A polypeptide of the present invention preferably comprises the amino acid sequence of SEQ ID NO: 48 or an allelic variant thereof; or a fragment thereof that has degradation activity specific to the capsule of *Klebsiella pneumoniae* capsular type K36 strains. In a preferred aspect, a polypeptide comprises the amino acid sequence of SEQ ID NO: 48. In another preferred aspect, a polypeptide consists of the amino acid sequence of SEQ ID NO: 48 or an allelic variant thereof; or a fragment thereof that has degradation activity specific to the capsule of *Klebsiella pneumoniae* capsular type K36 strains. In another preferred aspect, a polypeptide consists of the amino acid sequence of SEQ ID NO: 48.

In a second aspect, the present invention relates to an isolated polypeptide having degradation activity specific to the capsule of *Klebsiella pneumoniae* capsular type K36 strains which is encoded by polynucleotides which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 47, (ii) a subsequence of (i), or (iii) a complementary strand of (i) or (ii) (J. Sambrook, E. F. Fritsch, and T, Maniatis, 1989, *Molecular Cloning, A Laboratory Manual,* 2d edition, Cold Spring Harbor, N.Y.). A subsequence of the polypeptide coding sequence of SEQ ID NO: 47 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K36 strains. In a preferred aspect, the polypeptide coding sequence is nucleotides as shown in SEQ ID NO: 47. In another preferred aspect, the complementary strand is the full-length complementary strand of the polypeptide coding sequence of SEQ ID NO: 47.

In a third aspect, the present invention relates to an isolated polypeptides encoded by polynucleotide comprising or consisting of nucleotide sequences which have a degree of identity to the sequence of SEQ ID NO: 47 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 47. See polynucleotide section herein.

In a fourth aspect, the present invention relates to artificial variants comprising a substitution, deletion, and/or insertion of one or more amino acids of the polypeptide of SEQ ID NO: 48; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

25. Polypeptide Specifically Degrading Capsule of *Klebsiella pneumoniae* Capsular Type K38 Strains The invention provides an isolated polypeptide having degradation activity specific to the capsule of *Klebsiella pneumoniae* capsular type K38 strains, selected from the group consisting of: (a) a polypeptide comprising an amino acid sequence which has at least 60% sequence identity with the mature polypeptide of SEQ ID NO: 50; (b) a polypeptide which is encoded by a polynucleotide which hybridizes under at least high stringency conditions with (i) the polypeptide coding sequence of SEQ ID NO: 49, (ii) a full-length complementary strand of (i)); and (c) a polypeptide which is encoded by a polynucleotide having at least 60% sequence identity with the mature polypeptide coding sequence of SEQ ID NO: 49.

In a first aspect, the present invention relates to an isolated polypeptides comprising an amino acid sequence which has a degree of identity to the polypeptide of SEQ ID NO: 50 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K38 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 50.

A polypeptide of the present invention preferably comprises the amino acid sequence of SEQ ID NO: 50 or an allelic variant thereof; or a fragment thereof that has degradation activity specific to the capsule of *Klebsiella pneumoniae* capsular type K38 strains. In a preferred aspect, a polypeptide comprises the amino acid sequence of SEQ ID NO: 50. In another preferred aspect, a polypeptide consists of the amino acid sequence of SEQ ID NO: 50 or an allelic variant thereof; or a fragment thereof that has degradation activity specific to the capsule of *Klebsiella pneumoniae* capsular type K38 strains. In another preferred aspect, a polypeptide consists of the amino acid sequence of SEQ ID NO: 50.

In a second aspect, the present invention relates to an isolated polypeptides having degradation activity specific to the capsule of *Klebsiella pneumoniae* capsular type K38 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 49, (ii) a subsequence of (i), or (iii) a complementary strand of (i) or (ii) (J. Sambrook, E. F. Fritsch, and T, Maniatis, 1989, *Molecular Cloning, A Laboratory Manual,* 2d edition, Cold Spring Harbor, N.Y.). A subsequence of the polypeptide coding sequence of SEQ ID NO: 49 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K38 strains. In a preferred aspect, the polypeptide coding sequence is nucleotides as shown in SEQ ID NO: 49. In another preferred aspect, the complementary strand is the full-length complementary strand of the polypeptide coding sequence of SEQ ID NO: 49.

In a third aspect, the present invention relates to an isolated polypeptides encoded by polynucleotide comprising or consisting of nucleotide sequences which have a degree of identity to the sequence of SEQ ID NO: 49 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 49. See polynucleotide section herein.

In a fourth aspect, the present invention relates to artificial variants comprising a substitution, deletion, and/or insertion of one or more amino acids of the polypeptide of SEQ ID NO: 50; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

26. Polypeptide Specifically Degrading Capsule of *Klebsiella pneumoniae* Capsular Type K39 Strains The invention provides an isolated polypeptide having degradation activity specific to the capsule of *Klebsiella pneumoniae* capsular type K39 strains, selected from the group consisting of: (a) a polypeptide comprising an amino acid sequence which has at least 60% sequence identity with the mature polypeptide of SEQ ID NO: 52; (b) a polypeptide which is encoded by a polynucleotide which hybridizes under at least high stringency conditions with (i) the polypeptide coding sequence of SEQ ID NO: 51, (ii) a full-length complementary strand of (i); and (c) a polypeptide which is encoded by a polynucleotide having at least 60% sequence identity with the mature polypeptide coding sequence of SEQ ID NO: 51.

In a first aspect, the present invention relates to an isolated polypeptide comprising an amino acid sequence which has a degree of identity to the polypeptide of SEQ ID NO: 52 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K39 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 52.

A polypeptide of the present invention preferably comprises the amino acid sequence of SEQ ID NO: 52 or an allelic variant thereof; or a fragment thereof that has degradation activity specific to the capsule of *Klebsiella pneumoniae* capsular type K39 strains. In a preferred aspect, a polypeptide comprises the amino acid sequence of SEQ ID NO: 52. In another preferred aspect, a polypeptide consists of the amino acid sequence of SEQ ID NO: 52 or an allelic variant thereof; or a fragment thereof that has degradation activity specific to the capsule of *Klebsiella pneumoniae* capsular type K39 strains. In another preferred aspect, a polypeptide consists of the amino acid sequence of SEQ ID NO: 52.

In a second aspect, the present invention relates to an isolated polypeptides having degradation activity specific to the capsule of *Klebsiella pneumoniae* capsular type K39 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 51, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 51 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K39 strains. In a preferred aspect, the polypeptide coding sequence is nucleotides as shown in SEQ ID NO: 51. In another preferred aspect, the complementary strand is the full-length complementary strand of the polypeptide coding sequence of SEQ ID NO: 51.

In a third aspect, the present invention relates to an isolated polypeptides encoded by polynucleotide comprising or consisting of nucleotide sequences which have a degree of identity to the sequence of SEQ ID NO: 51 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 51. See polynucleotide section herein.

In a fourth aspect, the present invention relates to artificial variants comprising a substitution, deletion, and/or insertion of one or more amino acids of the polypeptide of SEQ ID NO: 52; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

27. Polypeptide Specifically Degrading Capsule of *Klebsiella pneumoniae* Capsular Type K41 Strains The invention provides an isolated polypeptide having degradation activity specific to the capsule of *Klebsiella pneumoniae* capsular type K41 strains, selected from the group consisting of: (a) a polypeptide comprising an amino acid sequence which has at least 60% sequence identity with the mature polypeptide of SEQ ID NO: 54; (b) a polypeptide which is encoded by a polynucleotide which hybridizes under at least high stringency conditions with (i) the polypeptide coding sequence of SEQ ID NO: 53, (ii) a full-length complementary strand of (i); and (c) a polypeptide which is encoded by a polynucleotide having at least 60% sequence identity with the mature polypeptide coding sequence of SEQ ID NO: 53.

In a first aspect, the present invention relates to an isolated polypeptides comprising an amino acid sequence which has a degree of identity to the polypeptide of SEQ ID NO: 54 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K41 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 54.

A polypeptide of the present invention preferably comprises the amino acid sequence of SEQ ID NO: 54 or an allelic variant thereof; or a fragment thereof that has degradation activity specific to the capsule of *Klebsiella pneumoniae* capsular type K41 strains. In a preferred aspect, a polypeptide comprises the amino acid sequence of SEQ ID NO: 54. In another preferred aspect, a polypeptide consists of the amino acid sequence of SEQ ID NO: 54 or an allelic variant thereof; or a fragment thereof that has degradation activity specific to the capsule of *Klebsiella pneumoniae* capsular type K41 strains. In another preferred aspect, a polypeptide consists of the amino acid sequence of SEQ ID NO: 54.

In a second aspect, the present invention relates to an isolated polypeptides having degradation activity specific to the capsule of *Klebsiella pneumoniae* capsular type K41 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 53, (ii) the cDNA sequence contained in the polypeptide coding sequence of SEQ ID NO: 53, (iii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 53 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K41 strains. In a preferred aspect, the polypeptide coding sequence is nucleotides as shown in SEQ ID NO: 53. In another preferred aspect, the complementary strand is the full-length complementary strand of the polypeptide coding sequence of SEQ ID NO: 53.

In a third aspect, the present invention relates to an isolated polypeptides encoded by polynucleotide comprising or consisting of nucleotide sequences which have a degree of identity to the sequence of SEQ ID NO: 53 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 53. See polynucleotide section herein.

In a fourth aspect, the present invention relates to artificial variants comprising a substitution, deletion, and/or insertion of one or more amino acids of the polypeptide of SEQ ID NO: 54; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

28. Polypeptide Specifically Degrading Capsule of *Klebsiella pneumoniae* Capsular Type K42 Strains The invention provides an isolated polypeptide having degradation activity specific to the capsule of *Klebsiella pneumoniae* capsular type K42 strains, selected from the group consisting of: (a) a polypeptide comprising an amino acid sequence which has at least 60% sequence identity with the mature polypeptide of SEQ ID NO: 56; (b) a polypeptide which is encoded by a polynucleotide which hybridizes under at least high stringency conditions with (i) the polypeptide coding sequence of SEQ ID NO: 55, (ii) a full-length complementary strand of (i)); and (c) a polypeptide which is encoded by a polynucleotide having at least 60% sequence identity with the mature polypeptide coding sequence of SEQ ID NO: 55.

In a first aspect, the present invention relates to an isolated polypeptide comprising an amino acid sequence which has a degree of identity to the polypeptide of SEQ ID NO: 56 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K42 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 56.

A polypeptide of the present invention preferably comprises the amino acid sequence of SEQ ID NO: 56 or an allelic variant thereof; or a fragment thereof that has degradation activity specific to the capsule of *Klebsiella pneumoniae* capsular type K42 strains. In a preferred aspect, a polypeptide comprises the amino acid sequence of SEQ ID NO: 56. In another preferred aspect, a polypeptide consists of the amino acid sequence of SEQ ID NO: 56 or an allelic variant thereof; or a fragment thereof that has degradation activity specific to the capsule of *Klebsiella pneumoniae* capsular type K42 strains. In another preferred aspect, a polypeptide consists of the amino acid sequence of SEQ ID NO: 56.

In a second aspect, the present invention relates to an isolated polypeptide having degradation activity specific to the capsule of *Klebsiella pneumoniae* capsular type K42 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 55, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 55 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K42 strains. In a preferred aspect, the polypeptide coding sequence is nucleotides as shown in SEQ ID NO: 55. In another preferred aspect, the complementary strand is the full-length complementary strand of the polypeptide coding sequence of SEQ ID NO: 55.

In a third aspect, the present invention relates to an isolated polypeptide encoded by polynucleotide comprising or consisting of nucleotide sequences which have a degree of identity to the sequence of SEQ ID NO: 55 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 55. See polynucleotide section herein.

In a fourth aspect, the present invention relates to artificial variants comprising a substitution, deletion, and/or insertion of one or more amino acids of the polypeptide of SEQ ID NO: 56; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

29. Polypeptide Specifically Degrading Capsule of *Klebsiella pneumoniae* Capsular Type K29 Strains The invention provides an isolated polypeptide having degradation activity specific to the capsule of *Klebsiella pneumoniae* capsular type K29 strains, selected from the group consisting of: (a) a polypeptide comprising an amino acid sequence which has at least 60% sequence identity with the mature polypeptide of SEQ ID NO: 58; (b) a polypeptide which is encoded by a polynucleotide which hybridizes under at least high stringency conditions with (i) the polypeptide coding sequence of SEQ ID NO: 57, (ii) a full-length complementary strand of (i); and (c) a polypeptide which is encoded by a polynucleotide having at least 60% sequence identity with the mature polypeptide coding sequence of SEQ ID NO: 57.

In a first aspect, the present invention relates to an isolated polypeptide comprising an amino acid sequence which has a degree of identity to the polypeptide of SEQ ID NO: 58 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K29 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 58.

A polypeptide of the present invention preferably comprises the amino acid sequence of SEQ ID NO: 58 or an allelic variant thereof; or a fragment thereof that has degradation activity specific to the capsule of *Klebsiella pneumoniae* capsular type K29 strains. In a preferred aspect, a polypeptide comprises the amino acid sequence of SEQ ID NO: 58. In another preferred aspect, a polypeptide consists of the amino acid sequence of SEQ ID NO: 58 or an allelic variant thereof; or a fragment thereof that has degradation activity specific to the capsule of *Klebsiella pneumoniae* capsular type K29 strains. In another preferred aspect, a polypeptide consists of the amino acid sequence of SEQ ID NO: 58.

In a second aspect, the present invention relates to an isolated polypeptides having degradation activity specific to the capsule of *Klebsiella pneumoniae* capsular type K29 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 57, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 57 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K29 strains. In a preferred aspect, the polypeptide coding sequence is nucleotides as shown in SEQ ID NO: 57. In another preferred aspect, the complementary strand is the full-length complementary strand of the polypeptide coding sequence of SEQ ID NO: 57.

In a third aspect, the present invention relates to an isolated polypeptide encoded by polynucleotide comprising or consisting of nucleotide sequences which have a degree of identity to the sequence of SEQ ID NO: 57 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 57. See polynucleotide section herein.

In a fourth aspect, the present invention relates to artificial variants comprising a substitution, deletion, and/or insertion of one or more amino acids of the polypeptide of SEQ ID NO: 58; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

30. Polypeptide Specifically Degrading Capsule of *Klebsiella pneumoniae* Capsular Type K45 Strains The invention provides an isolated polypeptide having degradation activity specific to the capsule of *Klebsiella pneumoniae* capsular type K45 strains, selected from the group consisting of: (a) a polypeptide comprising an amino acid sequence which has at least 60% sequence identity with the mature polypeptide of SEQ ID NO: 60; (b) a polypeptide which is encoded by a polynucleotide which hybridizes under at least high stringency conditions with (i) the polypeptide coding sequence of SEQ ID NO: 59, (ii) a full-length complementary strand of (i); and (c) a polypeptide which is encoded by a polynucleotide having at least 60% sequence identity with the mature polypeptide coding sequence of SEQ ID NO: 59.

In a first aspect, the present invention relates to an isolated polypeptide comprising an amino acid sequence which has a degree of identity to the polypeptide of SEQ ID NO: 60 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K45 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 60.

A polypeptide of the present invention preferably comprises the amino acid sequence of SEQ ID NO: 60 or an allelic variant thereof; or a fragment thereof that has degradation activity specific to the capsule of *Klebsiella pneumoniae* capsular type K45 strains. In a preferred aspect, a polypeptide comprises the amino acid sequence of SEQ ID NO: 60. In another preferred aspect, a polypeptide consists of the amino acid sequence of SEQ ID NO: 60 or an allelic variant thereof; or a fragment thereof that has degradation activity specific to the capsule of *Klebsiella pneumoniae* capsular type K45 strains. In another preferred aspect, a polypeptide consists of the amino acid sequence of SEQ ID NO: 60.

In a second aspect, the present invention relates to an isolated polypeptide having degradation activity specific to the capsule of *Klebsiella pneumoniae* capsular type K45 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 59, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 59 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K45 strains. In a preferred aspect, the polypeptide coding sequence is nucleotides as shown in SEQ ID NO: 59. In another preferred aspect, the complementary strand is the full-length complementary strand of the polypeptide coding sequence of SEQ ID NO: 59.

In a third aspect, the present invention relates to an isolated polypeptide encoded by polynucleotide comprising or consisting of nucleotide sequences which have a degree of identity to the sequence of SEQ ID NO: 59 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 59. See polynucleotide section herein.

In a fourth aspect, the present invention relates to artificial variants comprising a substitution, deletion, and/or insertion of one or more amino acids of the polypeptide of SEQ ID NO: 60; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

31. Polypeptide Specifically Degrading Capsule of *Klebsiella pneumoniae* Capsular Type K47 Strains The invention provides an isolated polypeptide having degradation activity specific to the capsule of *Klebsiella pneumoniae* capsular type K47 strains, selected from the group consisting of: (a) a polypeptide comprising an amino acid sequence which has at least 60% sequence identity with the mature polypeptide of SEQ ID NO: 62; (b) a polypeptide which is encoded by a polynucleotide which hybridizes under at least high stringency conditions with (i) the polypeptide coding sequence of SEQ ID NO: 61, (ii) a full-length complementary strand of (i) or (ii); and (c) a polypeptide which is encoded by a polynucleotide having at least 60% sequence identity with the mature polypeptide coding sequence of SEQ ID NO: 61.

In a first aspect, the present invention relates to an isolated polypeptide comprising an amino acid sequence which has a degree of identity to the polypeptide of SEQ ID NO: 62 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K47 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 62.

A polypeptide of the present invention preferably comprises the amino acid sequence of SEQ ID NO: 62 or an allelic variant thereof; or a fragment thereof that has degradation activity specific to the capsule of *Klebsiella pneumoniae* capsular type K47 strains. In a preferred aspect, a polypeptide comprises the amino acid sequence of SEQ ID NO: 62. In another preferred aspect, a polypeptide consists of the amino acid sequence of SEQ ID NO: 62 or an allelic variant thereof; or a fragment thereof that has degradation activity specific to the capsule of *Klebsiella pneumoniae* capsular type K47 strains. In another preferred aspect, a polypeptide consists of the amino acid sequence of SEQ ID NO: 62.

In a second aspect, the present invention relates to an isolated polypeptides having degradation activity specific to the capsule of *Klebsiella pneumoniae* capsular type K47 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 61, (ii) a subsequence of (i), or (iii) a complementary strand of (i) or (ii), (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 61 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K47 strains. In a preferred aspect, the polypeptide coding sequence is nucleotides as shown in SEQ ID NO: 61. In another preferred aspect, the complementary strand is the full-length complementary strand of the polypeptide coding sequence of SEQ ID NO: 61.

In a third aspect, the present invention relates to an isolated polypeptide encoded by polynucleotide comprising or consisting of nucleotide sequences which have a degree of identity to the sequence of SEQ ID NO: 61 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 61. See polynucleotide section herein.

In a fourth aspect, the present invention relates to artificial variants comprising a substitution, deletion, and/or insertion of one or more amino acids of the polypeptide of SEQ ID NO: 62; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

32. Polypeptide Specifically Degrading Capsule of *Klebsiella pneumoniae* Capsular Type K48 Strains The invention provides an isolated polypeptide having degradation activity specific to the capsule of *Klebsiella pneumoniae* capsular type K48 strains, selected from the group consisting of: (a) a polypeptide comprising an amino acid sequence which has at least 60% sequence identity with the mature polypeptide of SEQ ID NO: 64; (b) a polypeptide which is encoded by a polynucleotide which hybridizes under at least high stringency conditions with (i) the polypeptide coding sequence of SEQ ID NO: 63, (ii) a full-length complementary strand of (i) or (ii); and (c) a polypeptide which is encoded by a polynucleotide having at least 60% sequence identity with the mature polypeptide coding sequence of SEQ ID NO: 63.

In a first aspect, the present invention relates to an isolated polypeptide comprising an amino acid sequence which has a degree of identity to the polypeptide of SEQ ID NO: 64 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K48 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 64.

A polypeptide of the present invention preferably comprises the amino acid sequence of SEQ ID NO: 64 or an allelic variant thereof; or a fragment thereof that has degradation activity specific to the capsule of *Klebsiella pneumoniae* capsular type K48 strains. In a preferred aspect, a polypeptide comprises the amino acid sequence of SEQ ID NO: 64. In another preferred aspect, a polypeptide consists of the amino acid sequence of SEQ ID NO: 64 or an allelic variant thereof; or a fragment thereof that has degradation activity specific to the capsule of *Klebsiella pneumoniae* capsular type K48 strains. In another preferred aspect, a polypeptide consists of the amino acid sequence of SEQ ID NO: 64.

In a second aspect, the present invention relates to an isolated polypeptides having degradation activity specific to the capsule of *Klebsiella pneumoniae* capsular type K48 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 63, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 63 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K48 strains. In a preferred aspect, the polypeptide coding sequence is nucleotides as shown in SEQ ID NO: 63. In another preferred aspect, the complementary strand is the full-length complementary strand of the polypeptide coding sequence of SEQ ID NO: 63.

In a third aspect, the present invention relates to an isolated polypeptide encoded by polynucleotide comprising or consisting of nucleotide sequences which have a degree of identity to the sequence of SEQ ID NO: 63 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 63. See polynucleotide section herein.

In a fourth aspect, the present invention relates to artificial variants comprising a substitution, deletion, and/or insertion of one or more amino acids of the polypeptide of SEQ ID NO: 64; or a homologous sequence thereof. Preferably, amino acid changes are of a minor nature, that is conservative amino acid substitutions or insertions that do not significantly affect the folding and/or activity of the protein; small deletions, typically of one to about 30 amino acids;

small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

33. Polypeptide Specifically Degrading Capsule of *Klebsiella pneumoniae* Capsular Type K51 Strains The invention provides an isolated polypeptide having degradation activity specific to the capsule of *Klebsiella pneumoniae* capsular type K51 strains, selected from the group consisting of: (a) a polypeptide comprising an amino acid sequence which has at least 60% sequence identity with the mature polypeptide of SEQ ID NO: 66; (b) a polypeptide which is encoded by a polynucleotide which hybridizes under at least high stringency conditions with (i) the polypeptide coding sequence of SEQ ID NO: 65, (ii) a full-length complementary strand of (i); and (c) a polypeptide which is encoded by a polynucleotide having at least 60% sequence identity with the mature polypeptide coding sequence of SEQ ID NO: 65.

In a first aspect, the present invention relates to an isolated polypeptide comprising an amino acid sequence which has a degree of identity to the polypeptide of SEQ ID NO: 66 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K51 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 66.

A polypeptide of the present invention preferably comprises the amino acid sequence of SEQ ID NO: 66 or an allelic variant thereof; or a fragment thereof that has degradation activity specific to the capsule of *Klebsiella pneumoniae* capsular type K51 strains. In a preferred aspect, a polypeptide comprises the amino acid sequence of SEQ ID NO: 66. In another preferred aspect, a polypeptide consists of the amino acid sequence of SEQ ID NO: 66 or an allelic variant thereof; or a fragment thereof that has degradation activity specific to the capsule of *Klebsiella pneumoniae* capsular type K51 strains. In another preferred aspect, a polypeptide consists of the amino acid sequence of SEQ ID NO: 66.

In a second aspect, the present invention relates to an isolated polypeptide having degradation activity specific to the capsule of *Klebsiella pneumoniae* capsular type K51 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 65, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 65 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K51 strains. In a preferred aspect, the polypeptide coding sequence is nucleotides as shown in SEQ ID NO: 65. In another preferred aspect, the complementary strand is the full-length complementary strand of the polypeptide coding sequence of SEQ ID NO: 65.

In a third aspect, the present invention relates to an isolated polypeptide encoded by polynucleotide comprising or consisting of nucleotide sequences which have a degree of identity to the sequence of SEQ ID NO: 65 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 65. See polynucleotide section herein.

In a fourth aspect, the present invention relates to artificial variants comprising a substitution, deletion, and/or insertion of one or more amino acids of the polypeptide of SEQ ID NO: 66; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

34. Polypeptide Specifically Degrading Capsule of *Klebsiella pneumoniae* Capsular Type K52 Strains The invention provides an isolated polypeptide having degradation activity specific to the capsule of *Klebsiella pneumoniae* capsular type K52 strains, selected from the group consisting of: (a) a polypeptide comprising an amino acid sequence which has at least 60% sequence identity with the mature polypeptide of SEQ ID NO: 68; (b) a polypeptide which is encoded by a polynucleotide which hybridizes under at least high stringency conditions with (i) the polypeptide coding sequence of SEQ ID NO: 67, (ii) a full-length complementary strand of (i); and (c) a polypeptide which is encoded by a polynucleotide having at least 60% sequence identity with the mature polypeptide coding sequence of SEQ ID NO: 67.

In a first aspect, the present invention relates to an isolated polypeptide comprising an amino acid sequence which has a degree of identity to the polypeptide of SEQ ID NO: 68 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K52 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 68.

A polypeptide of the present invention preferably comprises the amino acid sequence of SEQ ID NO: 68 or an allelic variant thereof; or a fragment thereof that has degradation activity specific to the capsule of *Klebsiella pneumoniae* capsular type K52 strains. In a preferred aspect, a polypeptide comprises the amino acid sequence of SEQ ID NO: 68. In another preferred aspect, a polypeptide consists of the amino acid sequence of SEQ ID NO: 68 or an allelic variant thereof; or a fragment thereof that has degradation activity specific to the capsule of *Klebsiella pneumoniae* capsular type K52 strains. In another preferred aspect, a polypeptide consists of the amino acid sequence of SEQ ID NO: 68.

In a second aspect, the present invention relates to an isolated polypeptide having degradation activity specific to the capsule of *Klebsiella pneumoniae* capsular type K52 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 67, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 67 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K52 strains. In a preferred aspect, the polypeptide coding sequence is nucleotides as shown in SEQ ID NO: 67. In another preferred aspect, the complementary strand is the full-length complementary strand of the polypeptide coding sequence of SEQ ID NO: 67.

In a third aspect, the present invention relates to an isolated polypeptide encoded by polynucleotide comprising or consisting of nucleotide sequences which have a degree of identity to the sequence of SEQ ID NO: 67 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 67. See polynucleotide section herein.

In a fourth aspect, the present invention relates to artificial variants comprising a substitution, deletion, and/or insertion of one or more amino acids of the polypeptide of SEQ ID NO: 68; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

35. Polypeptide Specifically Degrading Capsule of *Klebsiella pneumoniae* Capsular Type K54 Strains The invention provides an isolated polypeptide having degradation activity specific to the capsule of *Klebsiella pneumoniae* capsular type K54 strains, selected from the group consisting of: (a) a polypeptide comprising an amino acid sequence which has at least 60% sequence identity with the mature polypeptide of SEQ ID NO: 70; (b) a polypeptide which is encoded by a polynucleotide which hybridizes under at least high stringency conditions with (i) the polypeptide coding sequence of SEQ ID NO: 69, (ii) a full-length complementary strand of (i); and (c) a polypeptide which is encoded by a polynucleotide having at least 60% sequence identity with the mature polypeptide coding sequence of SEQ ID NO: 69.

In a first aspect, the present invention relates to an isolated polypeptide comprising an amino acid sequence which has a degree of identity to the polypeptide of SEQ ID NO: 70 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K54 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 70.

A polypeptide of the present invention preferably comprises the amino acid sequence of SEQ ID NO: 70 or an allelic variant thereof; or a fragment thereof that has degradation activity specific to the capsule of *Klebsiella pneumoniae* capsular type K54 strains. In a preferred aspect, a polypeptide comprises the amino acid sequence of SEQ ID NO: 70. In another preferred aspect, a polypeptide consists of the amino acid sequence of SEQ ID NO: 70 or an allelic variant thereof; or a fragment thereof that has degradation activity specific to the capsule of *Klebsiella pneumoniae* capsular type K54 strains. In another preferred aspect, a polypeptide consists of the amino acid sequence of SEQ ID NO: 70.

In a second aspect, the present invention relates to an isolated polypeptide having degradation activity specific to the capsule of *Klebsiella pneumoniae* capsular type K54 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 69, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 69 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K54 strains. In a preferred aspect, the polypeptide coding sequence is nucleotides as shown in SEQ ID NO: 69. In another preferred aspect, the complementary strand is the full-length complementary strand of the polypeptide coding sequence of SEQ ID NO: 69.

In a third aspect, the present invention relates to an isolated polypeptide encoded by polynucleotide comprising or consisting of nucleotide sequences which have a degree of identity to the sequence of SEQ ID NO: 69 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 69. See polynucleotide section herein.

In a fourth aspect, the present invention relates to artificial variants comprising a substitution, deletion, and/or insertion of one or more amino acids of the polypeptide of SEQ ID NO: 70; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

36. Polypeptide Specifically Degrading Capsule of *Klebsiella pneumoniae* Capsular Type K56 Strains The invention provides an isolated polypeptide having degradation activity specific to the capsule of *Klebsiella pneumoniae* capsular type K56 strains, selected from the group consisting of: (a) a polypeptide comprising an amino acid sequence which has at least 60% sequence identity with the mature polypeptide of SEQ ID NO: 72; (b) a polypeptide which is encoded by a polynucleotide which hybridizes under at least high stringency conditions with (i) the polypeptide coding sequence of SEQ ID NO: 71, (ii) a full-length complementary strand of (i); and (c) a polypeptide which is encoded by a polynucleotide having at least 60% sequence identity with the mature polypeptide coding sequence of SEQ ID NO: 71.

In a first aspect, the present invention relates to an isolated polypeptide comprising an amino acid sequence which has a degree of identity to the polypeptide of SEQ ID NO: 72 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K56 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 72.

A polypeptide of the present invention preferably comprises the amino acid sequence of SEQ ID NO: 72 or an allelic variant thereof; or a fragment thereof that has degradation activity specific to the capsule of *Klebsiella pneumoniae* capsular type K56 strains. In a preferred aspect, a polypeptide comprises the amino acid sequence of SEQ ID NO: 72. In another preferred aspect, a polypeptide consists of the amino acid sequence of SEQ ID NO: 72 or an allelic variant thereof; or a fragment thereof that has degradation activity specific to the capsule of *Klebsiella pneumoniae* capsular type K56 strains. In another preferred aspect, a polypeptide consists of the amino acid sequence of SEQ ID NO: 72.

In a second aspect, the present invention relates to an isolated polypeptide having degradation activity specific to the capsule of *Klebsiella pneumoniae* capsular type K56 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 71, (ii) a subsequence of (i), or (iii) a complementary strand of (i) or (ii) (J. Sambrook, E. F. Fritsch, and T, Maniatis, 1989, *Molecular Cloning, A Laboratory Manual,* 2d edition, Cold Spring Harbor, N.Y.). A subsequence of the polypeptide coding sequence of SEQ ID NO: 71 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K56 strains. In a preferred aspect, the polypeptide coding sequence is nucleotides as shown in SEQ ID NO: 71. In another preferred aspect, the complementary strand is the full-length complementary strand of the polypeptide coding sequence of SEQ ID NO: 71.

In a third aspect, the present invention relates to an isolated polypeptide encoded by polynucleotide comprising or consisting of nucleotide sequences which have a degree of identity to the sequence of SEQ ID NO: 71 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 71. See polynucleotide section herein.

In a fourth aspect, the present invention relates to artificial variants comprising a substitution, deletion, and/or insertion of one or more amino acids of the polypeptide of SEQ ID NO: 72; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

37. Polypeptide Specifically Degrading Capsule of *Klebsiella pneumoniae* Capsular Type K57 Strains The invention provides an isolated polypeptide having degradation activity specific to the capsule of *Klebsiella pneumoniae* capsular type K57 strains, selected from the group consisting of: (a) a polypeptide comprising an amino acid sequence which has at least 60% sequence identity with the mature polypeptide of SEQ ID NO: 74; (b) a polypeptide which is encoded by a polynucleotide which hybridizes under at least high stringency conditions with (i) the polypeptide coding sequence of SEQ ID NO: 73, (ii) a full-length complementary strand of (i); and (c) a polypeptide which is encoded by a polynucleotide having at least 60% sequence identity with the mature polypeptide coding sequence of SEQ ID NO: 73.

In a first aspect, the present invention relates to an isolated polypeptide comprising an amino acid sequence which has a degree of identity to the polypeptide of SEQ ID NO: 74 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K57 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 74.

A polypeptide of the present invention preferably comprises the amino acid sequence of SEQ ID NO: 74 or an allelic variant thereof; or a fragment thereof that has degradation activity specific to the capsule of *Klebsiella pneumoniae* capsular type K57 strains. In a preferred aspect, a polypeptide comprises the amino acid sequence of SEQ ID NO: 74. In another preferred aspect, a polypeptide consists of the amino acid sequence of SEQ ID NO: 74 or an allelic variant thereof; or a fragment thereof that has degradation activity specific to the capsule of *Klebsiella pneumoniae* capsular type K57 strains. In another preferred aspect, a polypeptide consists of the amino acid sequence of SEQ ID NO: 74.

In a second aspect, the present invention relates to an isolated polypeptide having degradation activity specific to the capsule of *Klebsiella pneumoniae* capsular type K57 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 73, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 73 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K57 strains. In a preferred aspect, the polypeptide coding sequence is nucleotides as shown in SEQ ID NO: 73. In another preferred aspect, the complementary strand is the full-length complementary strand of the polypeptide coding sequence of SEQ ID NO: 73.

In a third aspect, the present invention relates to an isolated polypeptide encoded by polynucleotide comprising or consisting of nucleotide sequences which have a degree of identity to the sequence of SEQ ID NO: 73 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 73. See polynucleotide section herein.

In a fourth aspect, the present invention relates to artificial variants comprising a substitution, deletion, and/or insertion of one or more amino acids of the polypeptide of SEQ ID NO: 74; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

38. Polypeptide Specifically Degrading Capsule of *Klebsiella pneumoniae* Capsular Type K58 Strains The invention provides an isolated polypeptide having degradation activity specific to the capsule of *Klebsiella pneumoniae* capsular type K58 strains, selected from the group consisting of: (a) a polypeptide comprising an amino acid sequence which has at least 60% sequence identity with the mature polypeptide of SEQ ID NO: 76; (b) a polypeptide which is encoded by a polynucleotide which hybridizes under at least high stringency conditions with (i) the polypeptide coding sequence of SEQ ID NO: 75, (ii) a full-length complementary strand of (i); and (c) a polypeptide which is encoded by a polynucleotide having at least 60% sequence identity with the mature polypeptide coding sequence of SEQ ID NO: 75.

In a first aspect, the present invention relates to an isolated polypeptide comprising an amino acid sequence which has a degree of identity to the polypeptide of SEQ ID NO: 76 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K58 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 76.

A polypeptide of the present invention preferably comprises the amino acid sequence of SEQ ID NO: 76 or an allelic variant thereof; or a fragment thereof that has degradation activity specific to the capsule of *Klebsiella pneumoniae* capsular type K58 strains. In a preferred aspect, a polypeptide comprises the amino acid sequence of SEQ ID NO: 76. In another preferred aspect, a polypeptide consists of the amino acid sequence of SEQ ID NO: 76 or an allelic variant thereof; or a fragment thereof that has degradation activity specific to the capsule of *Klebsiella pneumoniae* capsular type K58 strains. In another preferred aspect, a polypeptide consists of the amino acid sequence of SEQ ID NO: 76.

In a second aspect, the present invention relates to an isolated polypeptide having degradation activity specific to the capsule of *Klebsiella pneumoniae* capsular type K58 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 75, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 75 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K58 strains. In a preferred aspect, the polypeptide coding sequence is nucleotides as shown in SEQ ID NO: 75. In another preferred aspect, the complementary strand is the full-length complementary strand of the polypeptide coding sequence of SEQ ID NO: 75.

In a third aspect, the present invention relates to an isolated polypeptide encoded by polynucleotide comprising or consisting of nucleotide sequences which have a degree of identity to the sequence of SEQ ID NO: 75 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 75. See polynucleotide section herein.

In a fourth aspect, the present invention relates to artificial variants comprising a substitution, deletion, and/or insertion of one or more amino acids of the polypeptide of SEQ ID NO: 76; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

39. Polypeptide Specifically Degrading Capsule of *Klebsiella pneumoniae* Capsular Type K62 Strains The invention provides an isolated polypeptide having degradation activity specific to the capsule of *Klebsiella pneumoniae* capsular type K62 strains, selected from the group consisting of: (a) a polypeptide comprising an amino acid sequence which has at least 60% sequence identity with the mature polypeptide of SEQ ID NO: 78; (b) a polypeptide which is encoded by a polynucleotide which hybridizes under at least high stringency conditions with (i) the polypeptide coding sequence of SEQ ID NO: 77, (ii) a full-length complementary strand of (i) or (ii); and (c) a polypeptide which is encoded by a polynucleotide having at least 60% sequence identity with the mature polypeptide coding sequence of SEQ ID NO: 77.

In a first aspect, the present invention relates to an isolated polypeptide comprising an amino acid sequence which has a degree of identity to the polypeptide of SEQ ID NO: 78 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K62 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 78.

A polypeptide of the present invention preferably comprises the amino acid sequence of SEQ ID NO: 78 or an allelic variant thereof; or a fragment thereof that has degradation activity specific to the capsule of *Klebsiella pneumoniae* capsular type K62 strains. In a preferred aspect, a polypeptide comprises the amino acid sequence of SEQ ID NO: 78. In another preferred aspect, a polypeptide consists of the amino acid sequence of SEQ ID NO: 78 or an allelic variant thereof; or a fragment thereof that has degradation activity specific to the capsule of *Klebsiella pneumoniae* capsular type K62 strains. In another preferred aspect, a polypeptide consists of the amino acid sequence of SEQ ID NO: 78.

In a second aspect, the present invention relates to an isolated polypeptide having degradation activity specific to the capsule of *Klebsiella pneumoniae* capsular type K62 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 77, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 77 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K62 strains. In a preferred aspect, the polypeptide coding sequence is nucleotides as shown in SEQ ID NO: 77. In another preferred aspect, the complementary strand is the full-length complementary strand of the polypeptide coding sequence of SEQ ID NO: 77.

In a third aspect, the present invention relates to an isolated polypeptide encoded by polynucleotide comprising or consisting of nucleotide sequences which have a degree of identity to the sequence of SEQ ID NO: 77 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 77. See polynucleotide section herein.

In a fourth aspect, the present invention relates to artificial variants comprising a substitution, deletion, and/or insertion of one or more amino acids of the polypeptide of SEQ ID NO: 78; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

40. Polypeptide Specifically Degrading Capsule of *Klebsiella pneumoniae* Capsular Type K63 Strains The invention provides an isolated polypeptide having degradation activity specific to the capsule of *Klebsiella pneumoniae* capsular type K63 strains, selected from the group consisting of: (a) a polypeptide comprising an amino acid sequence which has at least 60% sequence identity with the mature polypeptide of SEQ ID NO: 80; (b) a polypeptide which is encoded by a polynucleotide which hybridizes under at least high stringency conditions with (i) the polypeptide coding sequence of SEQ ID NO: 79, (ii) a full-length complementary strand of (i); and (c) a polypeptide which is encoded by a polynucleotide having at least 60% sequence identity with the mature polypeptide coding sequence of SEQ ID NO: 79.

In a first aspect, the present invention relates to an isolated polypeptides comprising an amino acid sequence which has a degree of identity to the polypeptide of SEQ ID NO: 80 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of Klebsiella pneumoniae capsular type K63 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 80.

A polypeptide of the present invention preferably comprises the amino acid sequence of SEQ ID NO: 80 or an allelic variant thereof; or a fragment thereof that has degradation activity specific to the capsule of Klebsiella pneumoniae capsular type K63 strains. In a preferred aspect, a polypeptide comprises the amino acid sequence of SEQ ID NO: 80. In another preferred aspect, a polypeptide consists of the amino acid sequence of SEQ ID NO: 80 or an allelic variant thereof; or a fragment thereof that has degradation activity specific to the capsule of Klebsiella pneumoniae capsular type K63 strains. In another preferred aspect, a polypeptide consists of the amino acid sequence of SEQ ID NO: 80.

In a second aspect, the present invention relates to an isolated polypeptide having degradation activity specific to the capsule of Klebsiella pneumoniae capsular type K63 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 79, (ii) a subsequence of (i), or (iii) a complementary strand of (i) or (ii) (J. Sambrook, E. F. Fritsch, and T, Maniatis, 1989, Molecular Cloning, A Laboratory Manual, 2d edition, Cold Spring Harbor, N.Y.). A subsequence of the polypeptide coding sequence of SEQ ID NO: 79 contains at least 100 contiguous nucleotides or preferably at least 200 contiguous nucleotides. Moreover, the subsequence may encode a polypeptide fragment which has degradation activity specific to the capsule of Klebsiella pneumoniae capsular type K63 strains. In a preferred aspect, the polypeptide coding sequence is nucleotides as shown in SEQ ID NO: 79. In another preferred aspect, the complementary strand is the full-length complementary strand of the polypeptide coding sequence of SEQ ID NO: 79.

In a third aspect, the present invention relates to an isolated polypeptide encoded by polynucleotide comprising or consisting of nucleotide sequences which have a degree of identity to the sequence of SEQ ID NO: 79 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 79. See polynucleotide section herein.

In a fourth aspect, the present invention relates to artificial variants comprising a substitution, deletion, and/or insertion of one or more amino acids of the polypeptide of SEQ ID NO: 80; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

41. Polypeptide Specifically Degrading Capsule of Klebsiella pneumoniae Capsular Type K64 Strains The invention provides an isolated polypeptide having degradation activity specific to the capsule of Klebsiella pneumoniae capsular type K64 strains, selected from the group consisting of: (a) a polypeptide comprising an amino acid sequence which has at least 60% sequence identity with the mature polypeptide of SEQ ID NO: 82; (b) a polypeptide which is encoded by a polynucleotide which hybridizes under at least high stringency conditions with (i) the polypeptide coding sequence of SEQ ID NO: 81, (ii) a full-length complementary strand of (i); and (c) a polypeptide which is encoded by a polynucleotide having at least 60% sequence identity with the mature polypeptide coding sequence of SEQ ID NO: 81.

In a first aspect, the present invention relates to an isolated polypeptide comprising an amino acid sequence which has a degree of identity to the polypeptide of SEQ ID NO: 82 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of Klebsiella pneumoniae capsular type K64 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 82.

A polypeptide of the present invention preferably comprises the amino acid sequence of SEQ ID NO: 82 or an allelic variant thereof; or a fragment thereof that has degradation activity specific to the capsule of Klebsiella pneumoniae capsular type K64 strains. In a preferred aspect, a polypeptide comprises the amino acid sequence of SEQ ID NO: 82. In another preferred aspect, a polypeptide consists of the amino acid sequence of SEQ ID NO: 82 or an allelic variant thereof; or a fragment thereof that has degradation activity specific to the capsule of Klebsiella pneumoniae capsular type K64 strains. In another preferred aspect, a polypeptide consists of the amino acid sequence of SEQ ID NO: 82.

In a second aspect, the present invention relates to an isolated polypeptide having degradation activity specific to the capsule of *Klebsiella pneumoniae* capsular type K64 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 81, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 81 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K64 strains. In a preferred aspect, the polypeptide coding sequence is nucleotides as shown in SEQ ID NO: 81. In another preferred aspect, the complementary strand is the full-length complementary strand of the polypeptide coding sequence of SEQ ID NO: 81.

In a third aspect, the present invention relates to an isolated polypeptide encoded by polynucleotide comprising or consisting of nucleotide sequences which have a degree of identity to the sequence of SEQ ID NO: 81 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 81. See polynucleotide section herein.

In a fourth aspect, the present invention relates to artificial variants comprising a substitution, deletion, and/or insertion of one or more amino acids of the polypeptide of SEQ ID NO: 82; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

42. Polypeptide Specifically Degrading Capsule of *Klebsiella pneumoniae* Capsular Type K65 Strains The invention provides an isolated polypeptide having degradation activity specific to the capsule of *Klebsiella pneumoniae* capsular type K65 strains, selected from the group consisting of: (a) a polypeptide comprising an amino acid sequence which has at least 60% sequence identity with the mature polypeptide of SEQ ID NO: 84; (b) a polypeptide which is encoded by a polynucleotide which hybridizes under at least high stringency conditions with (i) the polypeptide coding sequence of SEQ ID NO: 83, (ii) a full-length complementary strand of (i); and (c) a polypeptide which is encoded by a polynucleotide having at least 60% sequence identity with the mature polypeptide coding sequence of SEQ ID NO: 83.

In a first aspect, the present invention relates to an isolated polypeptide comprising an amino acid sequence which has a degree of identity to the polypeptide of SEQ ID NO: 84 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K65 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 84.

A polypeptide of the present invention preferably comprises the amino acid sequence of SEQ ID NO: 84 or an allelic variant thereof; or a fragment thereof that has degradation activity specific to the capsule of *Klebsiella pneumoniae* capsular type K65 strains. In a preferred aspect, a polypeptide comprises the amino acid sequence of SEQ ID NO: 84. In another preferred aspect, a polypeptide consists of the amino acid sequence of SEQ ID NO: 84 or an allelic variant thereof; or a fragment thereof that has degradation activity specific to the capsule of *Klebsiella pneumoniae* capsular type K65 strains. In another preferred aspect, a polypeptide consists of the amino acid sequence of SEQ ID NO: 84.

In a second aspect, the present invention relates to an isolated polypeptide having degradation activity specific to the capsule of *Klebsiella pneumoniae* capsular type K65 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 83, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 83 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K65 strains. In a preferred aspect, the polypeptide coding sequence is nucleotides as shown in SEQ ID NO: 83. In another preferred aspect, the complementary strand is the full-length complementary strand of the polypeptide coding sequence of SEQ ID NO: 83.

In a third aspect, the present invention relates to an isolated polypeptide encoded by polynucleotide comprising or consisting of nucleotide sequences which have a degree of identity to the sequence of SEQ ID NO: 83 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 83. See polynucleotide section herein.

In a fourth aspect, the present invention relates to artificial variants comprising a substitution, deletion, and/or insertion of one or more amino acids of the polypeptide of SEQ ID NO: 84; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

43. Polypeptide Specifically Degrading Capsule of *Klebsiella pneumoniae* Capsular Type K66 Strains The invention provides an isolated polypeptide having degradation activity specific to the capsule of *Klebsiella pneumoniae* capsular type K66 strains, selected from the group consisting of: (a) a polypeptide comprising an amino acid sequence which has at least 60% sequence identity with the mature polypeptide of SEQ ID NO: 86; (b) a polypeptide which is encoded by a polynucleotide which hybridizes under at least high stringency conditions with (i) the polypeptide coding sequence of SEQ ID NO: 85, (ii) a full-length complementary strand of (i); and (c) a polypeptide which is encoded by a polynucleotide having at least 60% sequence identity with the mature polypeptide coding sequence of SEQ ID NO: 85.

In a first aspect, the present invention relates to an isolated polypeptide comprising an amino acid sequence which has a degree of identity to the polypeptide of SEQ ID NO: 86 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K66 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 86.

A polypeptide of the present invention preferably comprises the amino acid sequence of SEQ ID NO: 86 or an allelic variant thereof; or a fragment thereof that has degradation activity specific to the capsule of *Klebsiella pneumoniae* capsular type K66 strains. In a preferred aspect, a polypeptide comprises the amino acid sequence of SEQ ID NO: 86. In another preferred aspect, a polypeptide consists of the amino acid sequence of SEQ ID NO: 86 or an allelic variant thereof; or a fragment thereof that has degradation activity specific to the capsule of *Klebsiella pneumoniae* capsular type K66 strains. In another preferred aspect, a polypeptide consists of the amino acid sequence of SEQ ID NO: 86.

In a second aspect, the present invention relates to an isolated polypeptide having degradation activity specific to the capsule of *Klebsiella pneumoniae* capsular type K66 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 85, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 85 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K66 strains. In a preferred aspect, the polypeptide coding sequence is nucleotides as shown in SEQ ID NO: 85. In another preferred aspect, the complementary strand is the full-length complementary strand of the polypeptide coding sequence of SEQ ID NO: 85.

In a third aspect, the present invention relates to an isolated polypeptide encoded by polynucleotide comprising or consisting of nucleotide sequences which have a degree of identity to the sequence of SEQ ID NO: 85 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 85. See polynucleotide section herein.

In a fourth aspect, the present invention relates to artificial variants comprising a substitution, deletion, and/or insertion of one or more amino acids of the polypeptide of SEQ ID NO: 86; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

44. Polypeptide Specifically Degrading Capsule of *Klebsiella pneumoniae* Capsular Type K68 Strains The invention provides an isolated polypeptide having degradation activity specific to the capsule of *Klebsiella pneumoniae* capsular type K68 strains, selected from the group consisting of: (a) a polypeptide comprising an amino acid sequence which has at least 60% sequence identity with the mature polypeptide of SEQ ID NO: 88; (b) a polypeptide which is encoded by a polynucleotide which hybridizes under at least high stringency conditions with (i) the polypeptide coding sequence of SEQ ID NO: 87, (ii) a full-length complementary strand of (i); and (c) a polypeptide which is encoded by a polynucleotide having at least 60% sequence identity with the mature polypeptide coding sequence of SEQ ID NO: 87.

In a first aspect, the present invention relates to an isolated polypeptide comprising an amino acid sequence which has a degree of identity to the polypeptide of SEQ ID NO: 88 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K68 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 88.

A polypeptide of the present invention preferably comprises the amino acid sequence of SEQ ID NO: 88 or an allelic variant thereof; or a fragment thereof that has degradation activity specific to the capsule of *Klebsiella pneumoniae* capsular type K68 strains. In a preferred aspect, a polypeptide comprises the amino acid sequence of SEQ ID NO: 88. In another preferred aspect, a polypeptide consists of the amino acid sequence of SEQ ID NO: 88 or an allelic variant thereof; or a fragment thereof that has degradation activity specific to the capsule of *Klebsiella pneumoniae* capsular type K68 strains. In another preferred aspect, a polypeptide consists of the amino acid sequence of SEQ ID NO: 88.

In a second aspect, the present invention relates to an isolated polypeptide having degradation activity specific to the capsule of *Klebsiella pneumoniae* capsular type K68 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 87, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 87 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K68 strains. In a preferred aspect, the polypeptide coding sequence is nucleotides as shown in SEQ ID NO: 87. In another preferred aspect, the complementary strand is the full-length complementary strand of the polypeptide coding sequence of SEQ ID NO: 87.

In a third aspect, the present invention relates to an isolated polypeptide encoded by polynucleotide comprising or consisting of nucleotide sequences which have a degree of identity to the sequence of SEQ ID NO: 87 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 87. See polynucleotide section herein.

In a fourth aspect, the present invention relates to artificial variants comprising a substitution, deletion, and/or insertion of one or more amino acids of the polypeptide of SEQ ID NO: 88; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

45. Polypeptide Specifically Degrading Capsule of *Klebsiella pneumoniae* Capsular Type K72 Strains The invention provides an isolated polypeptide having degradation activity specific to the capsule of *Klebsiella pneumoniae* capsular type K72 strains, selected from the group consisting of: (a) a polypeptide comprising an amino acid sequence which has at least 60% sequence identity with the mature polypeptide of SEQ ID NO: 90; (b) a polypeptide which is encoded by a polynucleotide which hybridizes under at least high stringency conditions with (i) the polypeptide coding sequence of SEQ ID NO: 89, (ii) a full-length complementary strand of (i); and (c) a polypeptide which is encoded by a polynucleotide having at least 60% sequence identity with the mature polypeptide coding sequence of SEQ ID NO: 89.

In a first aspect, the present invention relates to an isolated polypeptide comprising an amino acid sequence which has a degree of identity to the polypeptide of SEQ ID NO: 90 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K72 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 90.

A polypeptide of the present invention preferably comprises the amino acid sequence of SEQ ID NO: 90 or an allelic variant thereof; or a fragment thereof that has degradation activity specific to the capsule of *Klebsiella pneumoniae* capsular type K72 strains. In a preferred aspect, a polypeptide comprises the amino acid sequence of SEQ ID NO: 90. In another preferred aspect, a polypeptide consists of the amino acid sequence of SEQ ID NO: 90 or an allelic variant thereof; or a fragment thereof that has degradation activity specific to the capsule of *Klebsiella pneumoniae* capsular type K72 strains. In another preferred aspect, a polypeptide consists of the amino acid sequence of SEQ ID NO: 90.

In a second aspect, the present invention relates to an isolated polypeptide having degradation activity specific to the capsule of *Klebsiella pneumoniae* capsular type K72 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 89, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 89 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K72 strains. In a preferred aspect, the polypeptide coding sequence is nucleotides as shown in SEQ ID NO: 89. In another preferred aspect, the complementary strand is the full-length complementary strand of the polypeptide coding sequence of SEQ ID NO: 89.

In a third aspect, the present invention relates to an isolated polypeptide encoded by polynucleotide comprising or consisting of nucleotide sequences which have a degree of identity to the sequence of SEQ ID NO: 89 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 89. See polynucleotide section herein.

In a fourth aspect, the present invention relates to artificial variants comprising a substitution, deletion, and/or insertion of one or more amino acids of the polypeptide of SEQ ID NO: 90; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

46. Polypeptide Specifically Degrading Capsule of *Klebsiella pneumoniae* Capsular Type K82 Strains The invention provides an isolated polypeptide having degradation activity specific to the capsule of *Klebsiella pneumoniae* capsular type K82 strains, selected from the group consisting of: (a) a polypeptide comprising an amino acid sequence which has at least 60% sequence identity with the mature polypeptide of SEQ ID NO: 92; (b) a polypeptide which is encoded by a polynucleotide which hybridizes under at least high stringency conditions with (i) the polypeptide coding sequence of SEQ ID NO: 91, (ii) a full-length complementary strand of (i); and (c) a polypeptide which is encoded by a polynucleotide having at least 60% sequence identity with the mature polypeptide coding sequence of SEQ ID NO: 91.

In a first aspect, the present invention relates to an isolated polypeptide comprising an amino acid sequence which has a degree of identity to the polypeptide of SEQ ID NO: 92 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type K82 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 92.

A polypeptide of the present invention preferably comprises the amino acid sequence of SEQ ID NO: 92 or an allelic variant thereof; or a fragment thereof that has degradation activity specific to the capsule of *Klebsiella pneumoniae* capsular type K82 strains. In a preferred aspect, a polypeptide comprises the amino acid sequence of SEQ ID NO: 92. In another preferred aspect, a polypeptide consists of the amino acid sequence of SEQ ID NO: 92 or an allelic variant thereof; or a fragment thereof that has degradation activity specific to the capsule of *Klebsiella pneumoniae* capsular type K82 strains. In another preferred aspect, a polypeptide consists of the amino acid sequence of SEQ ID NO: 92.

In a second aspect, the present invention relates to an isolated polypeptide having degradation activity specific to the capsule of *Klebsiella pneumoniae* capsular type K82 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 91, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 91 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type K82 strains. In a preferred aspect, the polypeptide coding sequence is nucleotides as shown in SEQ ID NO: 91. In another preferred aspect, the complementary strand is the full-length complementary strand of the polypeptide coding sequence of SEQ ID NO: 91.

In a third aspect, the present invention relates to an isolated polypeptide encoded by polynucleotide comprising or consisting of nucleotide sequences which have a degree of identity to the sequence of SEQ ID NO: 91 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 91. See polynucleotide section herein.

In a fourth aspect, the present invention relates to artificial variants comprising a substitution, deletion, and/or insertion of one or more amino acids of the polypeptide of SEQ ID NO: 92; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

47. Polypeptide Specifically Degrading Capsule of *Klebsiella pneumoniae* Capsular Type KN1 Strains The invention provides an isolated polypeptide having degradation activity specific to the capsule of *Klebsiella pneumoniae* capsular type KN1 strains, selected from the group consisting of: (a) a polypeptide comprising an amino acid sequence which has at least 60% sequence identity with the mature polypeptide of SEQ ID NO: 94; (b) a polypeptide which is encoded by a polynucleotide which hybridizes under at least high stringency conditions with (i) the polypeptide coding sequence of SEQ ID NO: 93, (ii) a full-length complementary strand of (i); and (c) a polypeptide which is encoded by a polynucleotide having at least 60% sequence identity with the mature polypeptide coding sequence of SEQ ID NO: 93.

In a first aspect, the present invention relates to an isolated polypeptide comprising an amino acid sequence which has a degree of identity to the polypeptide of SEQ ID NO: 94 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type KN1 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 94.

A polypeptide of the present invention preferably comprises the amino acid sequence of SEQ ID NO: 94 or an allelic variant thereof; or a fragment thereof that has degradation activity specific to the capsule of *Klebsiella pneumoniae* capsular type KN1 strains. In a preferred aspect, a polypeptide comprises the amino acid sequence of SEQ ID NO: 94. In another preferred aspect, a polypeptide consists of the amino acid sequence of SEQ ID NO: 94 or an allelic variant thereof; or a fragment thereof that has degradation activity specific to the capsule of *Klebsiella pneumoniae* capsular type KN1 strains. In another preferred aspect, a polypeptide consists of the amino acid sequence of SEQ ID NO: 94.

In a second aspect, the present invention relates to an isolated polypeptide having degradation activity specific to the capsule of *Klebsiella pneumoniae* capsular type KN1 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 93, (ii) a subsequence of (i), or (iii) a complementary strand of (i) or (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 93 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type KN1 strains. In a preferred aspect, the polypeptide coding sequence is nucleotides as shown in SEQ ID NO: 93. In another preferred aspect, the complementary strand is the full-length complementary strand of the polypeptide coding sequence of SEQ ID NO: 93.

In a third aspect, the present invention relates to an isolated polypeptide encoded by polynucleotide comprising or consisting of nucleotide sequences which have a degree of identity to the sequence of SEQ ID NO: 93 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 93. See polynucleotide section herein.

In a fourth aspect, the present invention relates to artificial variants comprising a substitution, deletion, and/or insertion of one or more amino acids of the polypeptide of SEQ ID NO: 94; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

48. Polypeptide Specifically Degrading Capsule of *Klebsiella pneumoniae* Capsular Type KN2 Strains The invention provides an isolated polypeptide having degradation activity specific to the capsule of *Klebsiella pneumoniae* capsular type KN2 strains, selected from the group consisting of: (a) a polypeptide comprising an amino acid sequence which has at least 60% sequence identity with the mature polypeptide of SEQ ID NO: 96; (b) a polypeptide which is encoded by a polynucleotide which hybridizes under at least high stringency conditions with (i) the polypeptide coding sequence of SEQ ID NO: 95, (ii) a full-length complementary strand of (i); and (c) a polypeptide which is encoded by a polynucleotide having at least 60% sequence identity with the mature polypeptide coding sequence of SEQ ID NO: 95.

In a first aspect, the present invention relates to an isolated polypeptide comprising an amino acid sequence which has a degree of identity to the polypeptide of SEQ ID NO: 96 of at least 60%, preferably at least 65%, more preferably at least 70%, more preferably at least 75%, more preferably at least 80%, more preferably at least 85%, even more preferably at least 90%, most preferably at least 95%, and even most preferably at least 96%, 97%, 98%, or 99%, which have degradation activity specific to the capsule of *Klebsiella pneumoniae* capsular type KN2 strains. In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the polypeptide of SEQ ID NO: 96.

A polypeptide of the present invention preferably comprises the amino acid sequence of SEQ ID NO: 96 or an allelic variant thereof; or a fragment thereof that has degradation activity specific to the capsule of *Klebsiella pneumoniae* capsular type KN2 strains. In a preferred aspect, a polypeptide comprises the amino acid sequence of SEQ ID NO: 96. In another preferred aspect, a polypeptide consists of the amino acid sequence of SEQ ID NO: 96 or an allelic variant thereof; or a fragment thereof that has degradation activity specific to the capsule of *Klebsiella pneumoniae* capsular type KN2 strains. In another preferred aspect, a polypeptide consists of the amino acid sequence of SEQ ID NO: 96.

In a second aspect, the present invention relates to an isolated polypeptide having degradation activity specific to the capsule of *Klebsiella pneumoniae* capsular type KN2 strains which is encoded by polynucleotide which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 95, (ii) a subsequence of (i), or (iii) a complementary strand of (i) or, (ii) (J. Sambrook, E. F. Fritsch, and T, Maniatis, 1989, *Molecular Cloning, A Laboratory Manual*, 2d edition, Cold Spring Harbor, N.Y.). A subsequence of the polypeptide coding sequence of SEQ ID NO: 95 contains at least 100 contiguous nucleotides or preferably at least 200 contiguous nucleotides. Moreover, the subsequence may encode a polypeptide fragment which has degradation activity specific to the capsule of *Klebsiella pneumoniae* capsular type KN2 strains. In a preferred aspect, the polypeptide coding sequence is nucleotides as shown in SEQ ID NO: 95. In another preferred aspect, the complementary strand is the full-length complementary strand of the polypeptide coding sequence of SEQ ID NO: 95.

In a third aspect, the present invention relates to an isolated polypeptide encoded by polynucleotide comprising or consisting of nucleotide sequences which have a degree of identity to the sequence of SEQ ID NO: 95 of at least 60%, preferably at least 65%, more preferably at least 70%, more preferably at least 75%, more preferably at least 80%, more preferably at least 85%, more preferably at least 90%, even more preferably at least 95%, and most preferably at least 96%, 97%, 98%, or 99% identity, which encode an active polypeptide. In a preferred aspect, the polypeptide is encoded by the nucleic acid of SEQ ID NO: 95. See polynucleotide section herein.

In a fourth aspect, the present invention relates to artificial variants comprising a substitution, deletion, and/or insertion of one or more amino acids of the polypeptide of SEQ ID NO: 96; or a homologous sequence thereof. Preferably, amino acid changes are of a minor nature, that is conservative amino acid substitutions or insertions that do not significantly affect the folding and/or activity of the protein; small deletions, typically of one to about 30 amino acids; small amino- or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

Examples of conservative substitutions of amino acids of the polypeptide mentioned in any of the above Items 1-48 are within the group of basic amino acids (arginine, lysine and histidine), acidic amino acids (glutamic acid and aspartic acid), polar amino acids (glutamine and asparagine), hydrophobic amino acids (leucine, isoleucine and valine), aromatic amino acids (phenylalanine, tryptophan and tyrosine), and small amino acids (glycine, alanine, serine, threonine and methionine). Amino acid substitutions which do not generally alter specific activity are known in the art and are described, for example, by H. Neurath and R. L. Hill, 1979, In, The Proteins, Academic Press, New York. The most commonly occurring exchanges are Ala/Ser, Val/Ile Asp/Glu, Thr/Ser, Ala/Thr, Ser/Asn, Ala/Val, Ser/Gly, Tyr/Phe, Ala/Pro, Lys/Arg, Asp/Asn, Leu/Ile, Leu/Val, Ala/Glu, and Asp/Gly.

In addition to the 20 standard amino acids, non-standard amino acids (such as 4-hydroxyproline, 6-N-methyl lysine, 2-aminoisobutyric acid, isovaline, and alpha-methyl serine) may be substituted for amino acid residues of a wild-type polypeptide. A limited number of non-conservative amino acids, amino acids that are not encoded by the genetic code, and unnatural amino acids may be substituted for amino acid residues. "Unnatural amino acids" have been modified after protein synthesis, and/or have a chemical structure in their side chain(s) different from that of the standard amino acids. Unnatural amino acids can be chemically synthesized, and preferably, are commercially available, and include pipecolic acid, thiazolidine carboxylic acid, dehydroproline, 3- and 4-methylproline, and 3,3-dimethylproline.

Alternatively, the amino acid changes are of such a nature that the physico-chemical properties of the polypeptides of the invention are altered. For example, amino acid changes may improve the thermal stability of the polypeptide, alter the substrate specificity, change the pH optimum, and the like.

Essential amino acids in the parent polypeptide mentioned in any of the above Items 1-48 can be identified according to procedures known in the art, such as site-directed mutagenesis or alanine-scanning mutagenesis (Cunningham and Wells, 1989, Science 244: 1081-1085). In the latter technique, single alanine mutations are introduced at every residue in the molecule, and the resultant mutant molecules are tested for biological activity (i.e., degradation activity specific to the capsule of *Klebsiella pneumoniae*) to identify amino acid residues that are critical to the activity of the molecule. See also, Hilton of et al., 1996, *J. Biol. Chem.* 271: 4699-4708. The active site of the polypeptide or other biological interaction can also be determined by physical analysis of structure, as determined by such techniques as nuclear magnetic resonance, crystallography, electron diffraction, or photoaffinity labeling, in conjunction with mutation of putative contact site amino acids. See, for example, de Vos et al., 1992, *Science* 255: 306-312; Smith et al., 1992, *J. Mol. Biol.* 224: 899-904: Wlodaver et al., 1992, *FEBS Lett.* 309: 59-64. The identities of essential amino acids can also be inferred from analysis of identities with polypeptides which are related to a polypeptide according to the invention.

Polynucleotides

The present invention also relates to an isolated polynucleotide comprising or consisting of a nucleotide sequence which encodes a polypeptide of the present invention having degradation activity specific to capsule of *Klebsiella pneumoniae*.

In a preferred aspect, the nucleotide sequence comprises or consists of SEQ ID NO: 1. The present invention also encompasses nucleotide sequences which encode polypeptides comprising or consisting of the amino acid sequence of SEQ ID NO: 2, which differ from SEQ ID NO: 1 by virtue of the degeneracy of the genetic code. The present invention also relates to subsequences of SEQ ID NO: 1 which encode fragments of SEQ ID NO: 2 that have degradation activity specific to the capsule of *Klebsiella pneumoniae* capsular type K1 strains.

In a preferred aspect, the nucleotide sequence comprises or consists of SEQ ID NO: 3. The present invention also encompasses nucleotide sequences which encode polypeptides comprising or consisting of the amino acid sequence of SEQ ID NO: 4, which differ from SEQ ID NO: 3 by virtue of the degeneracy of the genetic code. The present invention also relates to subsequences of SEQ ID NO: 3 which encode fragments of SEQ ID NO: 4 that have degradation activity specific to the capsule of *Klebsiella pneumoniae* capsular type K12 and/or K13 strains.

In a preferred aspect, the nucleotide sequence comprises or consists of SEQ ID NO: 5. The present invention also encompasses nucleotide sequences which encode polypeptides comprising or consisting of the amino acid sequence of SEQ ID NO: 6, which differ from SEQ ID NO: 5 by virtue of the degeneracy of the genetic code. The present invention also relates to subsequences of SEQ ID NO: 5 which encode fragments of SEQ ID NO: 6 that have degradation activity specific to the capsule of *Klebsiella pneumoniae* capsular type K3 strains.

In a preferred aspect, the nucleotide sequence comprises or consists of SEQ ID NO: 7. The present invention also encompasses nucleotide sequences which encode polypeptides comprising or consisting of the amino acid sequence of SEQ ID NO: 8, which differ from SEQ ID NO: 7 by virtue of the degeneracy of the genetic code. The present invention also relates to subsequences of SEQ ID NO: 7 which encode fragments of SEQ ID NO: 8 that have degradation activity specific to the capsule of *Klebsiella pneumoniae* capsular type K5 strains.

In a preferred aspect, the nucleotide sequence comprises or consists of SEQ ID NO: 9. The present invention also encompasses nucleotide sequences which encode polypeptides comprising or consisting of the amino acid sequence of SEQ ID NO: 10, which differ from SEQ ID NO: 9 by virtue of the degeneracy of the genetic code. The present invention also relates to subsequences of SEQ ID NO: 9 which encode fragments of SEQ ID NO: 10 that have degradation activity specific to the capsule of *Klebsiella pneumoniae* capsular type K7 strains.

In a preferred aspect, the nucleotide sequence comprises or consists of SEQ ID NO: 11. The present invention also encompasses nucleotide sequences which encode polypeptides comprising or consisting of the amino acid sequence of SEQ ID NO: 12, which differ from SEQ ID NO: 11 by virtue of the degeneracy of the genetic code. The present invention also relates to subsequences of SEQ ID NO: 11 which encode fragments of SEQ ID NO: 12 that have degradation activity specific to the capsule of *Klebsiella pneumoniae* capsular type 8 strains.

In a preferred aspect, the nucleotide sequence comprises or consists of SEQ ID NO: 13. The present invention also encompasses nucleotide sequences which encode polypeptides comprising or consisting of the amino acid sequence of SEQ ID NO: 14, which differ from SEQ ID NO: 13 by virtue of the degeneracy of the genetic code. The present invention also relates to subsequences of SEQ ID NO: 13 which encode fragments of SEQ ID NO: 14 that have degradation activity specific to the capsule of *Klebsiella pneumoniae* capsular type K9 strains.

In a preferred aspect, the nucleotide sequence comprises or consists of SEQ ID NO: 15. The present invention also encompasses nucleotide sequences which encode polypeptides comprising or consisting of the amino acid sequence of SEQ ID NO: 16, which differ from SEQ ID NO: 15 by virtue of the degeneracy of the genetic code. The present invention also relates to subsequences of SEQ ID NO: 15 which encode fragments of SEQ ID NO: 16 that have degradation activity specific to the capsule of *Klebsiella pneumoniae* capsular type K10 strains.

In a preferred aspect, the nucleotide sequence comprises or consists of SEQ ID NO: 17. The present invention also encompasses nucleotide sequences which encode polypeptides comprising or consisting of the amino acid sequence of SEQ ID NO: 18, which differ from SEQ ID NO: 17 by virtue of the degeneracy of the genetic code. The present invention also relates to subsequences of SEQ ID NO: 17 which encode fragments of SEQ ID NO: 18 that have degradation activity specific to the capsule of *Klebsiella pneumoniae* capsular type K11 strains.

In a preferred aspect, the nucleotide sequence comprises or consists of SEQ ID NO: 19. The present invention also encompasses nucleotide sequences which encode polypeptides comprising or consisting of the amino acid sequence of SEQ ID NO: 20, which differ from SEQ ID NO: 19 by virtue of the degeneracy of the genetic code. The present invention also relates to subsequences of SEQ ID NO: 19 which encode fragments of SEQ ID NO: 20 that have degradation activity specific to the capsule of *Klebsiella pneumoniae* capsular type K17 strains.

In a preferred aspect, the nucleotide sequence comprises or consists of SEQ ID NO: 21. The present invention also encompasses nucleotide sequences which encode polypeptides comprising or consisting of the amino acid sequence of SEQ ID NO: 22, which differ from SEQ ID NO: 21 by virtue of the degeneracy of the genetic code. The present invention also relates to subsequences of SEQ ID NO: 21 which encode fragments of SEQ ID NO: 22 that have degradation activity specific to the capsule of *Klebsiella pneumoniae* capsular type K19 strains.

In a preferred aspect, the nucleotide sequence comprises or consists of SEQ ID NO: 23. The present invention also encompasses nucleotide sequences which encode polypeptides comprising or consisting of the amino acid sequence of SEQ ID NO: 24, which differ from SEQ ID NO: 23 by virtue of the degeneracy of the genetic code. The present invention also relates to subsequences of SEQ ID NO: 23 which encode fragments of SEQ ID NO: 24 that have degradation activity specific to the capsule of *Klebsiella pneumoniae* capsular type K21 strains.

In a preferred aspect, the nucleotide sequence comprises or consists of SEQ ID NO: 25. The present invention also encompasses nucleotide sequences which encode polypeptides comprising or consisting of the amino acid sequence of SEQ ID NO: 26, which differ from SEQ ID NO: 25 by virtue of the degeneracy of the genetic code. The present invention also relates to subsequences of SEQ ID NO: 25 which encode fragments of SEQ ID NO: 26 that have degradation activity specific to the capsule of *Klebsiella pneumoniae* capsular type K22 strains.

In a preferred aspect, the nucleotide sequence comprises or consists of SEQ ID NO: 27. The present invention also encompasses nucleotide sequences which encode polypeptides comprising or consisting of the amino acid sequence of SEQ ID NO: 28, which differ from SEQ ID NO: 27 by virtue of the degeneracy of the genetic code. The present invention also relates to subsequences of SEQ ID NO: 27 which encode fragments of SEQ ID NO: 28 that have degradation activity specific to the capsule of *Klebsiella pneumoniae* capsular type K24 strains.

In a preferred aspect, the nucleotide sequence comprises or consists of SEQ ID NO: 29. The present invention also encompasses nucleotide sequences which encode polypeptides comprising or consisting of the amino acid sequence of SEQ ID NO: 30, which differ from SEQ ID NO: 29 by virtue of the degeneracy of the genetic code. The present invention also relates to subsequences of SEQ ID NO: 29 which encode fragments of SEQ ID NO: 30 that have degradation activity specific to the capsule of *Klebsiella pneumoniae* capsular type K25 strains.

In a preferred aspect, the nucleotide sequence comprises or consists of SEQ ID NO: 31. The present invention also encompasses nucleotide sequences which encode polypeptides comprising or consisting of the amino acid sequence of SEQ ID NO: 32, which differ from SEQ ID NO: 31 by virtue of the degeneracy of the genetic code. The present invention also relates to subsequences of SEQ ID NO: 31 which encode fragments of SEQ ID NO: 32 that have degradation activity specific to the capsule of *Klebsiella pneumoniae* capsular type K26 strains.

In a preferred aspect, the nucleotide sequence comprises or consists of SEQ ID NO: 33. The present invention also encompasses nucleotide sequences which encode polypeptides comprising or consisting of the amino acid sequence of SEQ ID NO: 34, which differ from SEQ ID NO: 33 by virtue of the degeneracy of the genetic code. The present invention also relates to subsequences of SEQ ID NO: 33 which encode fragments of SEQ ID NO: 34 that have degradation activity specific to the capsule of *Klebsiella pneumoniae* capsular type K27 strains.

In a preferred aspect, the nucleotide sequence comprises or consists of SEQ ID NO: 35. The present invention also encompasses nucleotide sequences which encode polypeptides comprising or consisting of the amino acid sequence of SEQ ID NO: 36, which differ from SEQ ID NO: 35 by virtue of the degeneracy of the genetic code. The present invention also relates to subsequences of SEQ ID NO: 35 which encode fragments of SEQ ID NO: 36 that have degradation activity specific to the capsule of *Klebsiella pneumoniae* capsular type K28 strains.

In a preferred aspect, the nucleotide sequence comprises or consists of SEQ ID NO: 37. The present invention also encompasses nucleotide sequences which encode polypeptides comprising or consisting of the amino acid sequence of SEQ ID NO: 38, which differ from SEQ ID NO: 37 by virtue of the degeneracy of the genetic code. The present invention also relates to subsequences of SEQ ID NO: 37 which encode fragments of SEQ ID NO: 38 that have degradation activity specific to the capsule of *Klebsiella pneumoniae* capsular type K30 and/or K69 strains.

In a preferred aspect, the nucleotide sequence comprises or consists of SEQ ID NO: 39. The present invention also encompasses nucleotide sequences which encode polypeptides comprising or consisting of the amino acid sequence of SEQ ID NO: 40, which differ from SEQ ID NO: 39 by virtue of the degeneracy of the genetic code. The present invention also relates to subsequences of SEQ ID NO: 39 which encode fragments of SEQ ID NO: 40 that have degradation activity specific to the capsule of *Klebsiella pneumoniae* capsular type K31 strains.

In a preferred aspect, the nucleotide sequence comprises or consists of SEQ ID NO: 41. The present invention also encompasses nucleotide sequences which encode polypeptides comprising or consisting of the amino acid sequence of SEQ ID NO: 42, which differ from SEQ ID NO: 41 by virtue of the degeneracy of the genetic code. The present invention also relates to subsequences of SEQ ID NO: 41 which encode fragments of SEQ ID NO: 42 that have degradation activity specific to the capsule of *Klebsiella pneumoniae* capsular type K33 strains.

In a preferred aspect, the nucleotide sequence comprises or consists of SEQ ID NO: 43. The present invention also encompasses nucleotide sequences which encode polypeptides comprising or consisting of the amino acid sequence of SEQ ID NO: 44, which differ from SEQ ID NO: 43 by virtue of the degeneracy of the genetic code. The present invention also relates to subsequences of SEQ ID NO: 43 which encode fragments of SEQ ID NO: 44 that have degradation activity specific to the capsule of *Klebsiella pneumoniae* capsular type K34 strains.

In a preferred aspect, the nucleotide sequence comprises or consists of SEQ ID NO: 45. The present invention also encompasses nucleotide sequences which encode polypeptides comprising or consisting of the amino acid sequence of SEQ ID NO: 46, which differ from SEQ ID NO: 45 by virtue of the degeneracy of the genetic code. The present invention also relates to subsequences of SEQ ID NO: 45 which encode fragments of SEQ ID NO: 46 that have degradation activity specific to the capsule of *Klebsiella pneumoniae* capsular type K35 strains.

In a preferred aspect, the nucleotide sequence comprises or consists of SEQ ID NO: 47. The present invention also encompasses nucleotide sequences which encode polypeptides comprising or consisting of the amino acid sequence of SEQ ID NO: 48, which differ from SEQ ID NO: 47 by virtue of the degeneracy of the genetic code. The present invention also relates to subsequences of SEQ ID NO: 47 which encode fragments of SEQ ID NO: 48 that have degradation activity specific to the capsule of *Klebsiella pneumoniae* capsular type K36 strains.

In a preferred aspect, the nucleotide sequence comprises or consists of SEQ ID NO: 49. The present invention also encompasses nucleotide sequences which encode polypeptides comprising or consisting of the amino acid sequence of SEQ ID NO: 50, which differ from SEQ ID NO: 49 by virtue of the degeneracy of the genetic code. The present invention also relates to subsequences of SEQ ID NO: 49 which encode fragments of SEQ ID NO: 50 that have degradation activity specific to the capsule of *Klebsiella pneumoniae* capsular type K38 strains.

In a preferred aspect, the nucleotide sequence comprises or consists of SEQ ID NO: 51. The present invention also encompasses nucleotide sequences which encode polypeptides comprising or consisting of the amino acid sequence of SEQ ID NO: 52, which differ from SEQ ID NO: 51 by virtue of the degeneracy of the genetic code. The present invention also relates to subsequences of SEQ ID NO: 51 which encode fragments of SEQ ID NO: 52 that have degradation activity specific to the capsule of *Klebsiella pneumoniae* capsular type K39 strains.

In a preferred aspect, the nucleotide sequence comprises or consists of SEQ ID NO: 53. The present invention also encompasses nucleotide sequences which encode polypeptides comprising or consisting of the amino acid sequence of SEQ ID NO: 54, which differ from SEQ ID NO: 53 by virtue of the degeneracy of the genetic code. The present invention also relates to subsequences of SEQ ID NO: 53 which encode fragments of SEQ ID NO: 54 that have degradation activity specific to the capsule of *Klebsiella pneumoniae* capsular type K41 strains.

In a preferred aspect, the nucleotide sequence comprises or consists of SEQ ID NO: 55. The present invention also encompasses nucleotide sequences which encode polypeptides comprising or consisting of the amino acid sequence of SEQ ID NO: 56, which differ from SEQ ID NO: 55 by virtue of the degeneracy of the genetic code. The present invention also relates to subsequences of SEQ ID NO: 55 which encode fragments of SEQ ID NO: 56 that have degradation activity specific to the capsule of *Klebsiella pneumoniae* capsular type K42 strains.

In a preferred aspect, the nucleotide sequence comprises or consists of SEQ ID NO: 57. The present invention also encompasses nucleotide sequences which encode polypeptides comprising or consisting of the amino acid sequence of SEQ ID NO: 58, which differ from SEQ ID NO: 57 by virtue of the degeneracy of the genetic code. The present invention also relates to subsequences of SEQ ID NO: 57 which encode fragments of SEQ ID NO: 58 that have degradation activity specific to the capsule of *Klebsiella pneumoniae* capsular type K44 strains.

In a preferred aspect, the nucleotide sequence comprises or consists of SEQ ID NO: 59. The present invention also encompasses nucleotide sequences which encode polypeptides comprising or consisting of the amino acid sequence of SEQ ID NO: 60, which differ from SEQ ID NO: 59 by virtue of the degeneracy of the genetic code. The present invention also relates to subsequences of SEQ ID NO: 59 which encode fragments of SEQ ID NO: 60 that have degradation activity specific to the capsule of *Klebsiella pneumoniae* capsular type K45 strains.

In a preferred aspect, the nucleotide sequence comprises or consists of SEQ ID NO: 61. The present invention also encompasses nucleotide sequences which encode polypeptides comprising or consisting of the amino acid sequence of SEQ ID NO: 62, which differ from SEQ ID NO: 61 by virtue of the degeneracy of the genetic code. The present invention also relates to subsequences of SEQ ID NO: 61 which encode fragments of SEQ ID NO: 62 that have degradation activity specific to the capsule of *Klebsiella pneumoniae* capsular type K47 strains.

In a preferred aspect, the nucleotide sequence comprises or consists of SEQ ID NO: 63. The present invention also encompasses nucleotide sequences which encode polypeptides comprising or consisting of the amino acid sequence of SEQ ID NO: 64, which differ from SEQ ID NO: 63 by virtue of the degeneracy of the genetic code. The present invention also relates to subsequences of SEQ ID NO: 63 which encode fragments of SEQ ID NO: 64 that have degradation activity specific to the capsule of *Klebsiella pneumoniae* capsular type K48 strains.

In a preferred aspect, the nucleotide sequence comprises or consists of SEQ ID NO: 65. The present invention also encompasses nucleotide sequences which encode polypeptides comprising or consisting of the amino acid sequence of SEQ ID NO: 66, which differ from SEQ ID NO: 65 by virtue of the degeneracy of the genetic code. The present invention also relates to subsequences of SEQ ID NO: 65 which encode fragments of SEQ ID NO: 66 that have degradation activity specific to the capsule of *Klebsiella pneumoniae* capsular type K51 strains.

In a preferred aspect, the nucleotide sequence comprises or consists of SEQ ID NO: 67. The present invention also encompasses nucleotide sequences which encode polypeptides comprising or consisting of the amino acid sequence of SEQ ID NO: 68, which differ from SEQ ID NO: 67 by virtue of the degeneracy of the genetic code. The present invention also relates to subsequences of SEQ ID NO: 67 which encode fragments of SEQ ID NO: 68 that have degradation activity specific to the capsule of *Klebsiella pneumoniae* capsular type K52 strains.

In a preferred aspect, the nucleotide sequence comprises or consists of SEQ ID NO: 69. The present invention also encompasses nucleotide sequences which encode polypeptides comprising or consisting of the amino acid sequence of SEQ ID NO: 70, which differ from SEQ ID NO: 69 by virtue of the degeneracy of the genetic code. The present invention also relates to subsequences of SEQ ID NO: 69 which encode fragments of SEQ ID NO: 70 that have degradation activity specific to the capsule of *Klebsiella pneumoniae* capsular type K54 strains.

In a preferred aspect, the nucleotide sequence comprises or consists of SEQ ID NO: 71. The present invention also encompasses nucleotide sequences which encode polypeptides comprising or consisting of the amino acid sequence of SEQ ID NO: 72, which differ from SEQ ID NO: 71 by virtue of the degeneracy of the genetic code. The present invention also relates to subsequences of SEQ ID NO: 71 which encode fragments of SEQ ID NO: 72 that have degradation activity specific to the capsule of *Klebsiella pneumoniae* capsular type K56 strains.

In a preferred aspect, the nucleotide sequence comprises or consists of SEQ ID NO: 73. The present invention also encompasses nucleotide sequences which encode polypeptides comprising or consisting of the amino acid sequence of SEQ ID NO: 74, which differ from SEQ ID NO: 73 by virtue of the degeneracy of the genetic code. The present invention also relates to subsequences of SEQ ID NO: 73 which encode fragments of SEQ ID NO: 74 that have degradation activity specific to the capsule of *Klebsiella pneumoniae* capsular type K57 strains.

In a preferred aspect, the nucleotide sequence comprises or consists of SEQ ID NO: 75. The present invention also encompasses nucleotide sequences which encode polypeptides comprising or consisting of the amino acid sequence of SEQ ID NO: 76, which differ from SEQ ID NO: 75 by virtue of the degeneracy of the genetic code. The present invention also relates to subsequences of SEQ ID NO: 75 which encode fragments of SEQ ID NO: 76 that have degradation activity specific to the capsule of *Klebsiella pneumoniae* capsular type K48 strains.

In a preferred aspect, the nucleotide sequence comprises or consists of SEQ ID NO: 77. The present invention also encompasses nucleotide sequences which encode polypeptides comprising or consisting of the amino acid sequence of SEQ ID NO: 78, which differ from SEQ ID NO: 77 by virtue of the degeneracy of the genetic code. The present invention also relates to subsequences of SEQ ID NO: 77 which encode fragments of SEQ ID NO: 78 that have degradation activity specific to the capsule of *Klebsiella pneumoniae* capsular type K62 strains.

In a preferred aspect, the nucleotide sequence comprises or consists of SEQ ID NO: 79. The present invention also encompasses nucleotide sequences which encode polypeptides comprising or consisting of the amino acid sequence of SEQ ID NO: 80, which differ from SEQ ID NO: 79 by virtue of the degeneracy of the genetic code. The present invention also relates to subsequences of SEQ ID NO: 79 which encode fragments of SEQ ID NO: 80 that have degradation activity specific to the capsule of *Klebsiella pneumoniae* capsular type K63 strains.

In a preferred aspect, the nucleotide sequence comprises or consists of SEQ ID NO: 81. The present invention also encompasses nucleotide sequences which encode polypeptides comprising or consisting of the amino acid sequence of SEQ ID NO: 82, which differ from SEQ ID NO: 81 by virtue of the degeneracy of the genetic code. The present invention also relates to subsequences of SEQ ID NO: 81 which encode fragments of SEQ ID NO: 82 that have degradation activity specific to the capsule of *Klebsiella pneumoniae* capsular type K64 strains.

In a preferred aspect, the nucleotide sequence comprises or consists of SEQ ID NO: 83. The present invention also encompasses nucleotide sequences which encode polypeptides comprising or consisting of the amino acid sequence of SEQ ID NO: 84, which differ from SEQ ID NO: 83 by virtue of the degeneracy of the genetic code. The present invention also relates to subsequences of SEQ ID NO: 83 which encode fragments of SEQ ID NO: 84 that have degradation activity specific to the capsule of *Klebsiella pneumoniae* capsular type K65 strains.

In a preferred aspect, the nucleotide sequence comprises or consists of SEQ ID NO: 85. The present invention also encompasses nucleotide sequences which encode polypeptides comprising or consisting of the amino acid sequence of SEQ ID NO: 86, which differ from SEQ ID NO: 85 by virtue of the degeneracy of the genetic code. The present invention also relates to subsequences of SEQ ID NO: 85 which encode fragments of SEQ ID NO: 86 that have degradation activity specific to the capsule of *Klebsiella pneumoniae* capsular type K66 strains.

In a preferred aspect, the nucleotide sequence comprises or consists of SEQ ID NO: 87. The present invention also encompasses nucleotide sequences which encode polypeptides comprising or consisting of the amino acid sequence of SEQ ID NO: 88, which differ from SEQ ID NO: 87 by virtue of the degeneracy of the genetic code. The present invention also relates to subsequences of SEQ ID NO: 87 which encode fragments of SEQ ID NO: 88 that have degradation activity specific to the capsule of Klebsiella pneumoniae capsular type K68 strains.

In a preferred aspect, the nucleotide sequence comprises or consists of SEQ ID NO: 89. The present invention also encompasses nucleotide sequences which encode polypeptides comprising or consisting of the amino acid sequence of SEQ ID NO: 90, which differ from SEQ ID NO: 89 by virtue of the degeneracy of the genetic code. The present invention also relates to subsequences of SEQ ID NO: 89 which encode fragments of SEQ ID NO: 90 that have degradation activity specific to the capsule of Klebsiella pneumoniae capsular type K72 strains.

In a preferred aspect, the nucleotide sequence comprises or consists of SEQ ID NO: 91. The present invention also encompasses nucleotide sequences which encode polypeptides comprising or consisting of the amino acid sequence of SEQ ID NO: 92, which differ from SEQ ID NO: 91 by virtue of the degeneracy of the genetic code. The present invention also relates to subsequences of SEQ ID NO: 91 which encode fragments of SEQ ID NO: 92 that have degradation activity specific to the capsule of Klebsiella pneumoniae capsular type K82 strains.

In a preferred aspect, the nucleotide sequence comprises or consists of SEQ ID NO: 93. The present invention also encompasses nucleotide sequences which encode polypeptides comprising or consisting of the amino acid sequence of SEQ ID NO: 94, which differ from SEQ ID NO: 93 by virtue of the degeneracy of the genetic code. The present invention also relates to subsequences of SEQ ID NO: 93 which encode fragments of SEQ ID NO: 94 that have degradation activity specific to the capsule of Klebsiella pneumoniae capsular type KN1 strains.

In a preferred aspect, the nucleotide sequence comprises or consists of SEQ ID NO: 95. The present invention also encompasses nucleotide sequences which encode polypeptides comprising or consisting of the amino acid sequence of SEQ ID NO: 96, which differ from SEQ ID NO: 95 by virtue of the degeneracy of the genetic code. The present invention also relates to subsequences of SEQ ID NO: 95 which encode fragments of SEQ ID NO: 96 that have degradation activity specific to the capsule of Klebsiella pneumoniae capsular type KN2 strains.

The present invention also relates to mutant polynucleotides comprising or consisting of at least one mutation in the polypeptide coding sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, or SEQ ID NO: 95, in which the mutant nucleotide sequence encodes the polypeptide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO:94, or SEQ ID NO: 96, respectively.

The techniques used to isolate or clone a polynucleotide encoding a polypeptide are known in the art and include isolation from genomic DNA, preparation from cDNA, or a combination thereof. The cloning of the polynucleotides of the present invention from such genomic DNA can be effected, e.g., by using the well known polymerase chain reaction (PCR) or antibody screening of expression libraries to detect cloned DNA fragments with shared structural features. See, e.g., Innis et al., 1990, *PCR: A Guide to Methods and Application*, Academic Press, New York. Other nucleic acid amplification procedures such as ligase chain reaction (LCR), ligated activated transcription (LAT) and nucleotide sequence-based amplification (NASBA) may be used.

The present invention also relates to isolated polynucleotides comprising or consisting of nucleotide sequences which have a degree of identity to the polypeptide coding sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, or SEQ ID NO: 95 of at least 60%, preferably at least 65%, more preferably at least 70%, more preferably at least 75%, more preferably at least 80%, more preferably at least 85%, more preferably at least 90%, even more preferably at least 95%, and most preferably at least 97%, 98% or 99% identity, which encode an active polypeptide.

Modification of a nucleotide sequence encoding a polypeptide of the present invention may be necessary for the synthesis of polypeptides substantially similar to the polypeptide. The term "substantially similar" to the polypeptide refers to non-naturally occurring forms of the polypeptide. These polypeptides may differ in some engineered way from the polypeptide isolated from its native source, e.g., artificial variants that differ in specific activity, thermostability, pH optimum, or the like. The variant sequence may be constructed on the basis of the nucleotide sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, or SEQ ID NO: 95, e.g., a subsequence thereof, and/or by introduction of nucleotide substitutions which do not give rise to another amino acid sequence of the polypeptide encoded by the nucleotide sequence, but which correspond to the codon usage of the host organism intended for production of the enzyme, or by introduction of nucleotide substitutions which may give rise to a different amino acid sequence. For a general description of nucleotide substitution, see, e.g., Ford et al., 1991, *Protein Expression and Purification* 2: 95-107.

It will be apparent to those skilled in the art that such substitutions can be made outside the regions critical to the function of the molecule and still result in an active polypeptide. Amino acid residues essential to the activity of the polypeptide encoded by an isolated polynucleotide of the invention, and therefore preferably not subject to substitution, may be identified according to procedures known in the art, such as site-directed mutagenesis or alanine-scanning mutagenesis. In the latter technique, mutations are introduced at every positively charged residue in the molecule, and the resultant mutant molecules are tested for endoglucanase activity to identify amino acid residues that are critical to the activity of the molecule. Sites of substrate-enzyme interaction can also be determined by analysis of the three-dimensional structure as determined by such techniques as nuclear magnetic resonance analysis, crystallography or photoaffinity labeling (see, e.g., de Vos et al., 1992, supra; Smith et al., 1992, supra; Wlodaver et al., 1992, supra).

The present invention also relates to isolated polynucleotides encoding a polypeptide of the present invention, which hybridize under very low stringency conditions, preferably low stringency conditions, more preferably medium stringency conditions, more preferably medium-high stringency conditions, even more preferably high stringency conditions, and most preferably very high stringency conditions with (i) the polypeptide coding sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, or SEQ ID NO: 95, (ii) the cDNA sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, or SEQ ID NO: 95, or (iii) a complementary strand of (i) or (ii); or allelic variants and subsequences thereof (Sambrook et al., 1989, supra), as defined herein.

The present invention also relates to isolated polynucleotides obtained by (a) hybridizing a population of DNA under very low, low, medium, medium-high, high, or very high stringency conditions with (i) the polypeptide coding sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, or SEQ ID NO: 95, (ii) the cDNA sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, or SEQ ID NO: 95, or (iii) a complementary strand of (i) or (ii); and (b) isolating the hybridizing polynucleotide, which encodes a polypeptide having degradation activity specific to capsule of *K. pneumonia*.

Preferably, the invention relates to an isolated polynucleotide as shown in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, or SEQ ID NO: 95.

By way of example and not limitation, procedures using such conditions of low stringency are shown in "Shilo and Weinberg, 1981, Proc. Natl. Acad. Sci. USA 78:6789-6792". Other conditions of low stringency which may be used are well known in the art (e.g., as employed for cross-species hybridizations.)

By way of example and not limitation, procedures using such conditions of high stringency are as follows: Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 .mu.g/ml denatured salmon sperm DNA. Filters are hybridized for 48 h at 65° C. in prehybridization mixture containing 100 µg/ml denatured salmon sperm DNA and $^{32}$P-labeled probe. Washing of filters is done at 37° C. for 1 h in a solution containing 2×SSC, 0.01% PVP, 0.01% Ficoll, and 0.01% BSA. This is followed by a wash in 0.1×SSC at 50° C. for 45 mM before autoradiography. Other conditions of high stringency which may be used are well known in the art.

By way of example and not limitation, a medium stringency condition could be provided by about 0.1 to 0.25 M NaCl at temperatures of about 37° C. to about 55° C., while a low stringency condition could be provided by about 0.15 M to about 0.9 M salt, at temperatures ranging from about 20° C. to about 55° C. Hybridization conditions can be readily manipulated depending on the desired results The polypeptides and polynucleotides according to the present invention can be prepared by any suitable method. They can in particular be obtained by chemical synthesis, but it is also possible to obtain them biologically, using in particular various vectors in suitable cell cultures, as will be described hereinafter. Those with knowledge in the field of the invention will be able to obtain various polynucleotides/polypeptides and will also be able to determine which, among the polynucleotides/polypeptides obtained, are those which have an appropriate biological activity.

Nucleic Acid Construct

The present invention also relates to nucleic acid constructs comprising an isolated polynucleotide of the present invention operably linked to one or more control sequences that direct the expression of the coding sequence in a suitable host cell under conditions compatible with the control sequences.

An isolated polynucleotide encoding a polypeptide of the present invention may be manipulated in a variety of ways to provide for expression of the polypeptide. Manipulation of the polynucleotide's sequence prior to its insertion into a vector may be desirable or necessary depending on the expression vector. The techniques for modifying polynucleotide sequences utilizing recombinant DNA methods are well known in the art.

The control sequence may be an appropriate promoter sequence, a nucleotide sequence which is recognized by a host cell for expression of a polynucleotide encoding a polypeptide of the present invention. The promoter sequence contains transcriptional control sequences which mediate the expression of the polypeptide. The promoter may be any nucleotide sequence which shows transcriptional activity in the host cell of choice including mutant, truncated, and hybrid promoters, and may be obtained from genes encoding extracellular or intracellular polypeptides either homologous or heterologous to the host cell.

Examples of suitable promoters for directing the transcription of the nucleic acid constructs of the present invention, especially in a bacterial host cell, are the promoters obtained from the *Escherichia, Bacillus,* and prokaryotic beta-lactamase gene (Villa-Kamaroff et at, 1978, Proceedings of the National Academy of Sciences USA 75: 3727-3731), as well as the tac promoter (DeBoer et al., Proceedings of the National Academy of Sciences USA 80: 21-25). Further promoters are described in "Useful proteins from recombinant bacteria" in Scientific American, 1980, 242: 74-94; and in Sambrook et al., 1989, supra.

Examples of suitable promoters for directing the transcription of the nucleic acid constructs of the present invention in a filamentous fungal host cell are promoters obtained from *Aspergillus, Rhizomucor, Fusarium* and *Trichoderma* etc.

In a yeast host, useful promoters are obtained from *Saccharomyces*. Other useful promoters for yeast host cells are described by Romanos et at, 1992, Yeast 8: 423-488.

Expression Vectors

The present invention also relates to recombinant expression vectors comprising a polynucleotide of the present invention, a promoter, and transcriptional and translational stop signals. The various nucleic acids and control sequences described herein may be joined together to produce a recombinant expression vector which may include one or more convenient restriction sites to allow for insertion or substitution of the nucleotide sequence encoding the polypeptide at such sites. Alternatively, a polynucleotide sequence of the present invention may be expressed by inserting the nucleotide sequence or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus) which can be conveniently subjected to recombinant DNA procedures and can bring about expression of the nucleotide sequence. The choice of the vector will typically depend on the compatibility of the vector with the host cell into which the vector is to be introduced. The vectors may be linear or closed circular plasmids.

The vector may be an autonomously replicating vector, i.e., a vector which exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

Possible vectors include, but are not limited to, plasmids and modified viruses, but the vector system must be compatible with the host cell used. Such vectors include, but are not limited to, bacteriophage such as lambda derivatives, or plasmids such as pET, pBAD, pTrcHis, pBR322 or pUC plasmid derivatives. The insertion into a cloning vector can, for example, be accomplished by ligating the DNA fragment into a cloning vector which has complementary cohesive termini. However, if the complementary restriction sites used to fragment the DNA are not present in the cloning vector, the ends of the DNA molecules may be enzymatically modified. Alternatively, any site desired may be produced by ligating nucleotide sequences (linkers) onto the DNA termini; these ligated linkers may comprise specific chemically synthesized oligonucleotides encoding restriction endonuclease recognition sequences. In an alternative method, the cleaved DNA may be modified by homopolymeric tailing. Recombinant molecules can be introduced into host cells via transformation, transfection, infection, electroporation, etc., so that many copies of the gene sequence are generated.

The nucleic acid sequences encoding the polypeptide of the invention are inserted into the vectors in a manner such that they will be expressed under appropriate conditions (e.g., in proper orientation and correct reading frame). The recombinant expression vector also comprises an "expression means". The term "expression means" refers to elements of a vector which are necessary for transcription and translation of the nucleic acid encoding the protein, including but not limited to promoter/enhancer elements, a replication site, an RNA polymerase binding sequence, a ribosomal binding sequence, sequences which are capable of providing phenotype selection (e.g., ampicillin or tetracycline resistance), peptide tags that permit isolation of the expressed protein, and signal sequences that direct secretion of the expressed protein and replicon and control sequences that can be used to transform host cells. The expression means is operatively coupled to the nucleic acid molecule encoding the polypeptide by linking the inserted nucleic acid molecule into the expression vector.

Any method known in the art for inserting DNA fragments into a vector may be used to construct expression vectors containing a polypeptide encoding nucleic acid molecule consisting of appropriate transcriptional/translational control signals and the polypeptide coding sequences. These methods may include in vitro recombinant DNA and synthetic techniques and in vivo recombination (genetic recombination). Commercially available vectors for expressing heterologous proteins in bacterial hosts include but are not limited to pZERO, pTrc99A, pUC19, pUC18, pKK223-3, pEX1, pCAL, pET, pSPUTK, pTrxFus, pFastBac, pThioHis, pTrcHis, pTrcHis2, and pLEx.

Host Cells

The host cell may be any cell useful in the recombinant production of a polypeptide of the present invention, e.g., a prokaryote or a eukaryote.

The prokaryotic host cell may be any Gram positive bacterium or a Gram negative bacterium. Gram positive bacteria include, but not limited to, *Bacillus, Streptococcus, Streptomyces, Staphylococcus, Enterococcus, Lactobacillus, Lactococcus, Clostridium, Geobacillus*, and *Oceanobacillus*. Gram negative bacteria include, but not limited to. *E. coli, Pseudomonas, Salmonella, Campylobacter, Helicobacter, Flavobacterium, Fusobacterium, Ilyobacter, Neisseria*, and *Ureaplasma*.

A variety of host-vector systems may be utilized to express the polypeptide-coding sequence. These include but are not limited to mammalian cell systems infected with virus (e.g., vaccinia virus, adenovirus, etc.), insect cell systems infected with virus (e.g., baculovirus), microorganisms such as yeast containing yeast vectors, or bacteria transformed with bacteriophage DNA, plasmid DNA, or cosmid DNA, plant cells or transgenic plants Hosts that are appropriate for expression of nucleic acid molecules of the present invention, fragments, analogues or variants thereof, may include *E. coli, Bacillus* species, *Klebsiella* species, *Haemophilus*, fungi, yeast, such as *Saccharomyces, Pichia, Bordetella*, or *Candida*, or the baculovirus expression system. Preferably, the host cell is a yeast or bacterium. In one embodiment, the host cell is an *E. coli* or *Klebsiella pneumoniae* cell.

Once a suitable host system and growth conditions are established, recombinant expression vectors can be propagated and prepared in quantity. Upon expression, a recombinant polypeptide of the invention is produced and can be recovered in a substantially purified from the cell paste, the cell extract or from the supernatant after centrifugation of the recombinant cell culture using techniques well known in the art.

The introduction of DNA into a *Bacillus* cell may, for instance, be effected by protoplast transformation (see, e.g., Chang and Cohen, 1979, Molecular General Genetics 168: 111-115), by using competent cells (see, e.g., Young and Spizizen, 1961, Journal of Bacteriology 81: 823-829, or Dubnau and Davidoff-Abelson, 1971, Journal of Molecular Biology 56: 209-221), by electroporation (see, e.g., Shigekawa and Dower, 1988, Biotechniques 6: 742-751), or by conjugation (see, e.g., Koehler and Thorne, 1987, Journal of Bacteriology 169: 5271-5278). The introduction of DNA into an *E. coli* cell may, for instance, be effected by protoplast transformation (see, e.g., Hanahan, 1983, J. Mol. Biol. 166: 557-580) or electroporation (see, e.g., Dower et al., 1988. Nucleic Acids Res. 16: 6127-6145). The introduction of DNA into a *Streptomyces* cell may, for instance, be effected by protoplast transformation and electroporation (see, e.g., Gong et al., 2004, Folia Microbiol. (Praha) 49: 399-405), by conjugation (see, e.g., Mazodier et al., 1989, J. Bacteria 171: 3583-3585), or by transduction (see, e.g., Burke et al., 2001, Proc. Natl. Acad. Sci. USA 98:6289-6294). The introduction of DNA into a *Pseudomonas* cell may, for instance, be effected by electroporation (see, e.g., Choi et al., 2006, J. Microbiol. Methods 64: 391-397) or by conjugation (see, e.g., Pinedo and Smets, 2005, Appl. Environ. Microbial. 71: 51-57). The introduction of DNA into a *Streptococcus* cell may, for instance, be effected by natural competence (see, e.g., Perry and Kuramitsu, 1981, Infect. Immun. 32: 1295-1297), by protoplast transformation (see, e.g., Catt and Jollick, 1991, Microbios. 68: 189-2070, by electroporation (see, e.g., Buckley et al., 1999, Appl. Environ. Microbial. 65: 3800-3804) or by conjugation (see, e.g., Clewell, 1981 Microbial. Rev. 45: 409-436). However, any method known in the for introducing DNA into a host cell can be used.

The host cell may also be a eukaryote, such as a mammalian, insect, plant, or fungal cell. In a more preferred aspect, the fungal host cell is a yeast cell. "Yeast" as used herein includes ascosporogenous yeast (Endomycetales), basidiosporogenous yeast, and yeast belonging to the Fungi Imperfect (Blastomycetes). Since the classification of yeast may change in the future, for the purposes of this invention, yeast shall be defined as described in Biology and Activities of Yeast (Skinner, F. A., Passmore, S. M., and Davenport. R. R., ads, Soc. App. Bacteriol. Symposium Series No. 9, 1980.

New Bacteriophage Specific to Capsular Type of *Klebsiella pneumoniae* Strains

The invention also relates to isolated or recombinant bacteriophages of *Klebsiella pneumoniae* capsular type strains.

In one aspect, the invention provides an isolated or recombinant bacteriophage specific to degrade capsule of *Klebsiella pneumoniae* capsular type K1 strains, which comprises the polynucleotide of SEQ ID NO: 1. The degradation activity may be caused by the lytic and endoglycosidase. In one embodiment, the isolated bacteriophage is bacteriophage φK1-1 that is deposited with the China General Microbiological Culture Collection Center (CGMCC) on 10 Mar. 2011 under the accession number CGMCC 4643 having activity degrading capsule of capsular type K1 strains, and variants thereof, wherein said variants have the same phenotypic characteristics as said bacteriophage and said variants have the same degradation activity against capsular type K1 strain as said bacteriophage. Preferably, the

*Klebsiella pneumoniae* capsular type K1 strain is *Klebsiella pneumoniae* NTUH-K2044. Preferably, the isolated bacteriophage is bacteriophage φK1-1 comprising the polynucleotide of SEQ ID NO: 97. According to the invention, the deposited bacteriophage has binding specificity for *Klebsiella pneumoniae* capsular type K1 strains, and is capable of lysing *Klebsiella pneumoniae* capsular type K1 strain.

In another aspect, the invention provides an isolated or recombinant bacteriophage specific to degrade the capsule of *Klebsiella pneumoniae* capsular type K2 and/or K13 strains, which comprises the polynucleotide of SEQ ID NO: 3. The degradation activity may be caused by glycosidase. In one embodiment, the isolated bacteriophage is bacteriophage A4528-K2-1 that is deposited with the Deutsche Sammlung von Mikroorganismen und Zellkulturen GmbH (DSMZ) on 10 Nov. 2011 under the accession number DSMZ 25343 having activity degrading capsule of capsular type K2 and/or K13 strains, and variants thereof, wherein said variants have the same phenotypic characteristics as said bacteriophage and said variants have the same degradation activity against capsular type K2 and/or K13 strain as said bacteriophage. Preferably, the isolated bacteriophage is bacteriophage A4528-K2-1 comprising the polynucleotide of SEQ ID NO: 98. According to the invention, the deposited bacteriophage has binding specificity for *Klebsiella pneumoniae* capsular type K2 and/or K13 strains, and is capable of lysing *Klebsiella pneumoniae* capsular type K2 and/or K13 strains.

In another aspect, the invention provides an isolated or recombinant bacteriophage specific to degrade capsule of *Klebsiella pneumoniae* capsular type K3 strains, which comprises the polynucleotide of SEQ ID NO: 5. The degradation activity may be caused by glycosidase. Preferably, the isolated bacteriophage is bacteriophage ref-K3-1.

In another aspect, the provides an isolated or recombinant bacteriophage specific to degrade capsule of *Klebsiella pneumoniae* capsular type K5 strains, which comprises the polynucleotide of SEQ ID NO: 7. The degradation activity may be caused by glycosidase. In one embodiment, the isolated bacteriophage is bacteriophage A44-K5-1 that is deposited with the Deutsche Sammlung von Mikroorganismen und Zellkulturen GmbH (DSMZ) on 10 Nov. 2011 under the accession number DSMZ 25340 having activity degrading capsule of capsular type K5 strains, and variants thereof, wherein said variants have the same phenotypic characteristics as said bacteriophage and said variants have the same degradation activity against capsular type K5 strain as said bacteriophage. Preferably, the isolated bacteriophage is bacteriophage A44-K5-1, which has genome as shown in SEQ ID NO: 99. According to the invention, the deposited bacteriophage has binding specificity for *Klebsiella pneumoniae* capsular type K5 strains, and is capable of lysing *Klebsiella pneumoniae* capsular type K5 strains.

In another aspect, the invention provides an isolated or recombinant bacteriophage specific to degrade capsule of *Klebsiella pneumoniae* capsular type K7 strains, which comprises the polynucleotide of SEQ ID NO: 9. The degradation activity may be caused by glycosidase. Preferably, the isolated bacteriophage is bacteriophage ref-K27-1.

In another aspect, the invention provides an isolated or recombinant bacteriophage specific to degrade capsule of *Klebsiella pneumoniae* capsular type K8 strains, which comprises the polynucleotide of SEQ ID NO: 11. The degradation activity may be caused by glycosidase. Preferably, the isolated bacteriophage is bacteriophage A44-K5-1 and variants thereof, as mentioned above. Preferably, the isolated bacteriophage is bacteriophage A44-K5-1.

In another aspect, the invention provides an isolated or recombinant bacteriophage specific to degrade capsule of *Klebsiella pneumoniae* capsular type K9 strains, which comprises the polynucleotide of SEQ ID NO: 13. The degradation activity may be caused by glycosidase. Preferably, the isolated bacteriophage is bacteriophage ref-K9-1.

In another aspect, the invention provides an isolated or recombinant bacteriophage specific to degrade capsule of *Klebsiella pneumoniae* capsular type K10 strains, which comprises the polynucleotide of SEQ ID NO: 15. The degradation activity may be caused by glycosidase. Preferably, the isolated bacteriophage is bacteriophage ref-K19-1.

In another aspect, the invention provides an isolated or recombinant bacteriophage specific to degrade capsule of *Klebsiella pneumoniae* capsular type K11 strains, which comprises the polynucleotide of SEQ ID NO: 17. The degradation activity may be caused by glycosidase. Preferably, the isolated bacteriophage is bacteriophage ref-K11-1.

In another aspect, the invention provides an isolated or recombinant bacteriophage specific to degrade capsule of *Klebsiella pneumoniae* capsular type K17 strains, which comprises the polynucleotide of SEQ ID NO: 19. The degradation activity may be caused by glycosidase. Preferably, the isolated bacteriophage is bacteriophage ref-K17-1.

In another aspect, the invention provides an isolated or recombinant bacteriophage specific to degrade capsule of *Klebsiella pneumoniae* capsular type K19 strains, which comprises the polynucleotide of SEQ ID NO: 21. The degradation activity may be caused by glycosidase. Preferably, the isolated bacteriophage is bacteriophage ref-K19-1.

In another aspect, the invention provides an isolated or recombinant bacteriophage specific to degrade capsule of *Klebsiella pneumoniae* capsular type K21 strains, which comprises the polynucleotide of SEQ ID NO: 23. The degradation activity may be caused by glycosidase. Preferably, the isolated bacteriophage is bacteriophage ref-K21-1.

In another aspect, the invention provides an isolated or recombinant bacteriophage specific to degrade capsule of *Klebsiella pneumoniae* capsular type K22 strains, which comprises the polynucleotide of SEQ ID NO: 25. The degradation activity may be caused by glycosidase. In one embodiment, the isolated bacteriophage is bacteriophage ref-K22-1 that is deposited with the Deutsche Sammlung von Mikroorganismen and Zellkulturen GmbH (DSMZ) on 10 Nov. 2011 under the accession number DSMZ 25345 having activity degrading capsule of capsular type K22 strains, and variants thereof, wherein said variants have the same phenotypic characteristics as said bacteriophage and said variants have the same degradation activity against capsular type K22 strain as said bacteriophage. Preferably, the isolated bacteriophage is bacteriophage ref-K22-1. According to the invention, the deposited bacteriophage has binding specificity for *Klebsiella pneumoniae* capsular type K22 strains, and is capable of lysing *Klebsiella pneumoniae* capsular type K22 strains.

In another aspect, the invention provides an isolated or recombinant bacteriophage specific to degrade capsule of *Klebsiella pneumoniae* capsular type K24 strains, which comprises the polynucleotide of SEQ ID NO: 27. The degradation activity may be caused by glycosidase. Preferably, the isolated bacteriophage is bacteriophage ref-K24-1.

In another aspect, the invention provides an isolated or recombinant bacteriophage specific to degrade capsule of *Klebsiella pneumoniae* capsular type K25 strains, which comprises the polynucleotide of SEQ ID NO: 29. The degradation activity may be caused by glycosidase. Preferably, the isolated bacteriophage is bacteriophage ref-K11-2.

In another aspect, the invention provides an isolated or recombinant bacteriophage specific to degrade capsule of *Klebsiella pneumoniae* capsular type K26 strains, which comprises the polynucleotide of SEQ ID NO: 31. The degradation activity may be caused by glycosidase. Preferably, the isolated bacteriophage is bacteriophage ref-K26-1.

In another aspect, the invention provides an isolated or recombinant bacteriophage specific to degrade capsule of *Klebsiella pneumoniae* capsular type K27 strains, which comprises the polynucleotide of SEQ ID NO: 33. The degradation activity may be caused by glycosidase. Preferably, the isolated bacteriophage is bacteriophage ref-K27-1.

In another aspect, the invention provides an isolated or recombinant bacteriophage specific to degrade capsule of *Klebsiella pneumoniae* capsular type K28 strains, which comprises the polynucleotide of SEQ ID NO: 35. The degradation activity may be caused by glycosidase. Preferably, the isolated bacteriophage is bacteriophage YD8-K28-1.

In another aspect, the invention provides an isolated or recombinant bacteriophage specific to degrade capsule of *Klebsiella pneumoniae* capsular type K30 and/or K69 strains, which comprises the polynucleotide of SEQ ID NO: 37. The degradation activity may be caused by glycosidase. Preferably, the isolated bacteriophage is bacteriophage ref-K5-2.

In another aspect, the invention provides an isolated or recombinant bacteriophage specific to degrade capsule of *Klebsiella pneumoniae* capsular type K31 strains, which comprises the polynucleotide of SEQ ID NO: 39. The degradation activity may be caused by glycosidase. Preferably, the isolated bacteriophage is bacteriophage ref-K21-2.

In another aspect, the invention provides an isolated or recombinant bacteriophage specific to degrade capsule of *Klebsiella pneumoniae* capsular type K33 strains, which comprises the polynucleotide of SEQ ID NO: 41. The degradation activity may be caused by glycosidase. In one embodiment, the isolated bacteriophage is bacteriophage ref-K33-1 that is deposited with the Deutsche Sammlung von Mikroorganismen and Zellkulturen GmbH (DSMZ) on 10 Nov. 2011 under the accession number DSMZ 25347 having activity degrading capsule of capsular type K33 strains, and variants thereof, wherein said variants have the same phenotypic characteristics as said bacteriophage and said variants have the same degradation activity against capsular type K33 strain as said bacteriophage. Preferably, the isolated bacteriophage is bacteriophage ref-K33-1. According to the invention, the deposited bacteriophage has binding specificity for *Klebsiella pneumoniae* capsular type K33 strains, and is capable of lysing *Klebsiella pneumoniae* capsular type K33 strains.

In another aspect, the invention provides an isolated or recombinant bacteriophage specific to degrade capsule of *Klebsiella pneumoniae* capsular type K34 strains, which comprises the polynucleotide of SEQ ID NO: 43. The degradation activity may be caused by glycosidase. Preferably, the isolated bacteriophage is bacteriophage ref-K34-1.

In another aspect, the invention provides an isolated or recombinant bacteriophage specific to degrade capsule of *Klebsiella pneumoniae* capsular type K35 strains, which comprises the polynucleotide of SEQ ID NO: 45. The degradation activity may be caused by glycosidase. Preferably, the isolated bacteriophage is bacteriophage ref-K35-1.

In another aspect, the invention provides an isolated or recombinant bacteriophage specific to degrade capsule of *Klebsiella pneumoniae* capsular type K36 strains, which comprises the polynucleotide of SEQ ID NO: 47. The degradation activity may be caused by glycosidase. Preferably, the isolated bacteriophage is bacteriophage ref-K19-1.

In another aspect, the invention provides an isolated or recombinant bacteriophage specific to degrade capsule of *Klebsiella pneumoniae* capsular type K38 strains, which comprises the polynucleotide of SEQ ID NO: 49. The degradation activity may be caused by glycosidase. Preferably, the isolated bacteriophage is bacteriophage ref-K23-1.

In another aspect, the invention provides an isolated or recombinant bacteriophage specific to degrade capsule of *Klebsiella pneumoniae* capsular type K39 strains, which comprises the polynucleotide of SEQ ID NO: 51. The degradation activity may be caused by glycosidase. Preferably, the isolated bacteriophage is bacteriophage ref-K39-1.

In another aspect, the invention provides an isolated or recombinant bacteriophage specific to degrade capsule of *Klebsiella pneumoniae* capsular type K41 strains, which comprises the polynucleotide of SEQ ID NO: 53. The degradation activity may be caused by glycosidase. Preferably, the isolated bacteriophage is bacteriophage ref-K41-1.

In another aspect, the invention provides an isolated or recombinant bacteriophage specific to degrade capsule of *Klebsiella pneumoniae* capsular type K42 strains, which comprises the polynucleotide of SEQ ID NO: 55. The degradation activity may be caused by glycosidase. Preferably, the isolated bacteriophage is bacteriophage ref-K42-1.

In another aspect, the invention provides an isolated or recombinant bacteriophage specific to degrade capsule of *Klebsiella pneumoniae* capsular type K44 strains, which comprises the polynucleotide of SEQ ID NO: 57. The degradation activity may be caused by glycosidase. Preferably, the isolated bacteriophage is bacteriophage ref-K44-1.

In another aspect, the invention provides an isolated or recombinant bacteriophage specific to degrade capsule of *Klebsiella pneumoniae* capsular type K45 strains, which comprises the polynucleotide of SEQ ID NO: 59. The degradation activity may be caused by glycosidase. Preferably, the isolated bacteriophage is bacteriophage ref-K45-1.

In another aspect, the invention provides an isolated or recombinant bacteriophage specific to degrade capsule of *Klebsiella pneumoniae* capsular type K47 strains, which comprises the polynucleotide of SEQ ID NO: 61. The degradation activity may be caused by glycosidase. Preferably, the isolated bacteriophage is bacteriophage ref-K47-1.

In another aspect, the invention provides an isolated or recombinant bacteriophage specific to degrade capsule of *Klebsiella pneumoniae* capsular type K48 strains, which comprises the polynucleotide of SEQ ID NO: 63. The degradation activity may be caused by glycosidase. Preferably, the isolated bacteriophage is bacteriophage ref-K21-1.

In another aspect, the invention provides an isolated or recombinant bacteriophage specific to degrade capsule of *Klebsiella pneumoniae* capsular type K51 strains, which comprises the polynucleotide of SEQ ID NO: 65. The degradation activity may be caused by glycosidase. Preferably, the isolated bacteriophage is bacteriophage ref-K51-1 comprising the polynucleotide of SEQ ID NO: 100.

In another aspect, the invention provides an isolated or recombinant bacteriophage specific to degrade capsule of *Klebsiella pneumoniae* capsular type K52 strains, which comprises the polynucleotide of SEQ ID NO: 67. The degradation activity may be caused by glycosidase. Preferably, the isolated bacteriophage is bacteriophage 0417-K52-1.

In another aspect, the invention provides an isolated or recombinant bacteriophage specific to degrade capsule of *Klebsiella pneumoniae* capsular type K54 strains, which comprises the polynucleotide of SEQ ID NO: 69. The degradation activity may be caused by tail spike 63 D sialidase and glycosidase. In one embodiment, the isolated bacteriophage is bacteriophage A1365-K54-1 that is deposited with the Deutsche Sammlung von Mikroorganismen and Zellkulturen GmbH (DSMZ) on 10 Nov. 2011 under the accession number DSMZ 25342 having activity degrading capsule of capsular type K54 strains, and variants thereof, wherein said variants have the same phenotypic characteristics as said bacteriophage and said variants have the same degradation activity against capsular type K54 strain as said bacteriophage. Preferably, the isolated bacteriophage is bacteriophage A1365-K54-1. According to the invention, the deposited bacteriophage has binding specificity for *Klebsiella pneumoniae* capsular type K54 strains, and is capable of lysing *Klebsiella pneumoniae* capsular type K54 strains.

In another aspect, the invention provides an isolated or recombinant bacteriophage specific to degrade capsule of *Klebsiella pneumoniae* capsular type K56 strains, which comprises the polynucleotide of SEQ ID NO: 71. The degradation activity may be caused by glycosidase. Preferably, the isolated bacteriophage is bacteriophage ref-K19-1.

In another aspect, the invention provides an isolated or recombinant bacteriophage specific to degrade capsule of *Klebsiella pneumoniae* capsular type K57 strains, which comprises the polynucleotide of SEQ ID NO: 73. The degradation activity may be caused by glycosidase. Preferably, the isolated bacteriophage is bacteriophage ref-K57-1.

In another aspect, the invention provides an isolated or recombinant bacteriophage specific to degrade capsule of *Klebsiella pneumoniae* capsular type K58 strains, which comprises the polynucleotide of SEQ ID NO: 75. The degradation activity may be caused by glycosidase. Preferably, the isolated bacteriophage is bacteriophage ref-K2-1.

In another aspect, the invention provides an isolated or recombinant bacteriophage specific to degrade capsule of *Klebsiella pneumoniae* capsular type K62 strains, which comprises the polynucleotide of SEQ ID NO: 77. The degradation activity may be caused by glycosidase. Preferably, the isolated bacteriophage is bacteriophage ref-K10-1.

In another aspect, the invention provides an isolated or recombinant bacteriophage specific to degrade capsule of *Klebsiella pneumoniae* capsular type K63 strains, which comprises the polynucleotide of SEQ ID NO: 79. The degradation activity may be caused by glycosidase and hydrolase. Preferably, the isolated bacteriophage is bacteriophage ref-K63-1.

In another aspect, the invention provides an isolated or recombinant bacteriophage specific to degrade capsule of *Klebsiella pneumoniae* capsular type K64 strains, which comprises the polynucleotide of SEQ ID NO: 81. The degradation activity may be caused by glycosidase. Preferably, the isolated bacteriophage is bacteriophage ref-K64-1.

In another aspect, the invention provides an isolated or recombinant bacteriophage specific to degrade capsule of *Klebsiella pneumoniae* capsular type K65 strains, which comprises the polynucleotide of SEQ ID NO: 83. The degradation activity may be caused by glycosidase. Preferably, the isolated bacteriophage is bacteriophage ref-K65-1.

In another aspect, the invention provides an isolated or recombinant bacteriophage specific to degrade capsule of *Klebsiella pneumoniae* capsular type K66 strains, which comprises the polynucleotide of SEQ ID NO: 85. The degradation activity may be caused by glycosidase. Preferably, the isolated bacteriophage is bacteriophage ref-K66-1.

In another aspect, the invention provides an isolated or recombinant bacteriophage specific to degrade capsule of *Klebsiella pneumoniae* capsular type K68 strains, which comprises the polynucleotide of SEQ ID NO: 87. The degradation activity may be caused by glycosidase. Preferably, the isolated bacteriophage is bacteriophage ref-K68-1.

In another aspect, the invention provides an isolated or recombinant bacteriophage specific to degrade capsule of *Klebsiella pneumoniae* capsular type K72 strains, which comprises the polynucleotide of SEQ ID NO: 89. The degradation activity may be caused by glycosidase. Preferably, the isolated bacteriophage is bacteriophage ref-K72-1.

In another aspect, the invention provides an isolated or recombinant bacteriophage specific to degrade capsule of *Klebsiella pneumoniae* capsular type K82 strains, which comprises the polynucleotide of SEQ ID NO: 91. The degradation activity may be caused by glycosidase. Preferably, the isolated bacteriophage is bacteriophage ref-K82-1.

In another aspect, the invention provides an isolated or recombinant bacteriophage specific to degrade capsule of *Klebsiella pneumoniae* capsular type KN1 strains, which comprises the polynucleotide of SEQ ID NO: 93. The degradation activity may be caused by glycosidase. In one embodiment, the isolated bacteriophage is bacteriophage A1517-KN-1 that is deposited with the Deutsche Sammlung von Mikroorganismen and Zellkulturen GmbH (DSMZ) on 10 Nov. 2011 under the accession number DSMZ 25341 having activity degrading capsule of capsular type KN1 strains, and variants thereof, wherein said variants have the same phenotypic characteristics as said bacteriophage and said variants have the same degradation activity against capsular type KN1 strain as said bacteriophage. Preferably, the isolated bacteriophage is bacteriophage A1517-KN-1. According to the invention, the deposited bacteriophage has binding specificity for *Klebsiella pneumoniae* capsular type KN1 strains, and is capable of lysing *Klebsiella pneumoniae* capsular type KN1 strains.

In another aspect, the invention provides an isolated or recombinant bacteriophage specific to degrade capsule of *Klebsiella pneumoniae* capsular type KN2 strains, which comprises the polynucleotide of SEQ ID NO: 95. The degradation activity may be caused by glycosidase. In one embodiment, the isolated bacteriophage is bacteriophage 0507-KN2-1 that is deposited with the Deutsche Sammlung von Mikroorganismen und Zellkulturen GmbH (DSMZ) on 10 Nov. 2011 under the accession number DSMZ 25338 having activity degrading capsule of capsular type KN2 strains, and variants thereof, wherein said variants have the same phenotypic characteristics as said bacteriophage and said variants have the same degradation activity against capsular type KN2 strain as said bacteriophage. Preferably, the isolated bacteriophage is bacteriophage 0507-KN2-1. According to the invention, the deposited bacteriophage has binding specificity for *Klebsiella pneumoniae* capsular type KN2 strains, and is capable of lysing *Klebsiella pneumoniae* capsular type KN2 strains.

In another aspect, the invention provides an isolated bacteriophage specific to degrade capsule of *Klebsiella pneumoniae* capsular type K20 strains, which is bacteriophage A13-K20-1 deposited with the Deutsche Sammlung von Mikroorganismen und Zellkulturen GmbH (DSMZ) on 10 Nov. 2011 under the accession number DSMZ 25360 having activity degrading capsule of capsular type K20 strains, and variants thereof, wherein said variants have the same phenotypic characteristics as said bacteriophage and said variants have the same degradation activity against capsular type K20 strain as said bacteriophage. Preferably, the isolated bacteriophage is bacteriophage A13-K20-1, which has the polynucleotide of SEQ ID NO: 100. According to the invention, the deposited bacteriophage has binding specificity for *Klebsiella pneumoniae* capsular type K20 strains In another aspect, the invention provides an isolated bacteriophage specific to degrade capsule of *Klebsiella pneumoniae* capsular type K37 strains, which is bacteriophage ref-K37-1 deposited with the Deutsche Sammlung von Mikroorganismen und Zellkulturen GmbH (DSMZ) on 10 Nov. 2011 under the accession number DSMZ 25348 having activity degrading capsule of capsular type K37 strains, and variants thereof, wherein said variants have the same phenotypic characteristics as said bacteriophage and said variants have the same degradation activity against capsular type K37 strain as said bacteriophage. According to the invention, the deposited bacteriophage has binding specificity for *Klebsiella pneumoniae* capsular type K37 strains.

In another aspect, the invention provides an isolated bacteriophage specific to degrade capsule of *Klebsiella pneumoniae* capsular type KN3 strains, which is bacteriophage 9522-KN3-1 deposited with the Deutsche Sammlung von Mikroorganismen und Zellkulturen GmbH (DSMZ) on 10 Nov. 2011 under the accession number DSMZ 25339 having activity degrading capsule of capsular type KN3 strains, and variants thereof, wherein said variants have the same phenotypic characteristics as said bacteriophage and said variants have the same degradation activity against capsular type KN3 strain as said bacteriophage. Preferably, the isolated bacteriophage is bacteriophage 9522-KN3-1. According to the invention, the deposited bacteriophage has binding specificity for *Klebsiella pneumoniae* capsular type KN3 strains.

In another aspect, the invention provides an isolated bacteriophage specific to degrade capsule of *Klebsiella pneumoniae* capsular type K13 strains, which is bacteriophage ref-K13-1 deposited with the Deutsche Sammlung von Mikroorganismen und Zellkulturen GmbH (DSMZ) on 10 Nov. 2011 under the accession number DSMZ 25344 having activity degrading capsule of capsular type K13 strains, and variants thereof, wherein said variants have the same phenotypic characteristics as said bacteriophage and said variants have the same degradation activity against capsular type K13 strain as said bacteriophage. Preferably, the isolated bacteriophage is bacteriophage ref-K13-1. According to the invention, the deposited bacteriophage has binding specificity for *Klebsiella pneumoniae* capsular type K13 strains.

In another aspect, the invention provides an isolated bacteriophage specific to degrade capsule of *Klebsiella pneumoniae* capsular type K25 strains, which is bacteriophage ref-K25-1 deposited with the Deutsche Sammlung von Mikroorganismen and Zellkulturen GmbH (DSMZ) on 10 Nov. 2011 under the accession number DSMZ 25346 having activity degrading capsule of capsular type K25 strains, and variants thereof, wherein said variants have the same phenotypic characteristics as said bacteriophage and said variants have the same degradation activity against capsular type K25 strain as said bacteriophage. Preferably, the isolated bacteriophage is bacteriophage ref-K25-1. According to the invention, the deposited bacteriophage has binding specificity for *Klebsiella pneumoniae* capsular type K25 strains.

In another aspect, the invention provides an isolated bacteriophage specific to degrade capsule of *Klebsiella pneumoniae* capsular type K57 strains, which is bacteriophage ref-K57-2 deposited with the Deutsche Sammlung von Mikroorganismen and Zellkulturen GmbH (DSMZ) on 10 Nov. 2011 under the accession number DSMZ 25349 having activity degrading capsule of capsular type K57 strains, and variants thereof, wherein said variants have the same phenotypic characteristics as said bacteriophage and said variants have the same degradation activity against capsular type K57 strain as said bacteriophage. Preferably, the isolated bacteriophage is bacteriophage ref-K57-2. According to the invention, the deposited bacteriophage has binding specificity for *Klebsiella pneumoniae* capsular type K57 strains, and is capable of lysing *Klebsiella pneumoniae* capsular type K57 strains.

The invention further provides variants of any of the above-mentioned bacteriophage, which are bacteriophage having minor variation(s) in the genomic sequence and polypeptides encoded thereby while retaining the same general genotypic and phenotypic characteristics as the deposited bacteriophage. The bacteriophage of the invention also includes progeny, bacteriophage recombinant(s) and bacteriophage derivative(s). In this regard, "progeny" shall mean replicates of the deposited bacteriophage, including descendants of the deposited bacteriophage created by serial passage of the deposited bacteriophage or by other means well known in the art, or bacteriophage whose RFLP profiles are substantially equivalent to the RFLP profile of the deposited bacteriophage. "Recombinant bacteriophage" shall mean all genetically modified versions of the deposited bacteriophage or its progeny, obtained by serial passaging (in vivo or in vitro) or genetic manipulations of the deposited bacteriophage or its progeny. Such manipulations include, but are not limited to, introducing genes or gene cassettes encoding alternative proteins or nonfunctional proteins, or noncoding nucleotide sequences into the genome of the deposited bacteriophage. "Derivatives" shall mean all substances that constitute subunits or expression products of the deposited bacteriophage or its progeny, including (but not limited to) phage nucleic acids, partial or complete phage genes, gene expression products, and structural components.

The invention is directed to a composition comprising one or more of the above-mentioned polypeptide or the bacteriophage, or its progeny, recombinants and derivatives and the use of the one or more of the above-mentioned polypeptide or bacteriophage, or its progeny, recombinants and derivatives, to control the growth or colonization of *Klebsiella pneumoniae* strains. The invention also provides methods of identifying *Klebsiella pneumoniae* strains as a bacterial diagnostic and/or detecting the presence of *Klebsiella pneumoniae* strains in a sample. The invention further provides methods of using one or more of the above-mentioned polypeptide or bacteriophage or its progeny, recombinants and derivatives for the removal of antibiotic-resistant or other undesirable pathogens from medical, veterinary, animal husbandry, or any additional environments. The invention additionally provides for methods of using one or more of the above-mentioned polypeptide or bacteriophage to prevent and/or treat human and animal diseases caused by *Klebsiella pneumoniae* strains. The above-mentioned polypeptide or bacteriophage is administered for the methods of the invention as a homogenous phage administration, or alternatively as a component of a multi-phage composition comprising several bacteriophages.

The above-mentioned polypeptide or bacteriophage, and/or its progeny and derivatives may be further useful as a tool for the phenotyping of *Klebsiella pneumoniae* strains. For example, one of skill in the art can use one or more of the above-mentioned polypeptide or bacteriophage of the invention to screen a panel of *Klebsiella pneumoniae* strain isolates to aid in the taxonomic identification of the *Kleb-* siella pneumoniae strains, by determining which isolates yield a positive degradation reaction to the capsule of *Klebsiella pneumoniae* strains. For example, see van der Mee-Marquet, N., M. Loessner, et al. (1997) "Evaluation of seven experimental phages for inclusion in the international phage set for the epidemiological typing of *Listeria monocytogenes*." Appl Environ Microbiol 63(9): 3374-3377.

Therapeutic and Prophylactic Compositions and their Use

The invention provides methods of treatment or prevention of infection caused by one or more *Klebsiella pneumoniae* strain(s) comprising administering to a subject an effective amount of one or more of the polypeptide of the invention or one or more of the bacteriophage of the invention. The subject is preferably an animal, including but not limited to animals such as monkeys, cows, pigs, horses, chickens, cats, dogs, etc., and is preferably a mammal, and most preferably human. In one specific embodiment, a non-human mammal is the subject. In another specific embodiment, a human is the subject.

Various delivery systems are known and can be used to administer the ORF33 polypeptide or the isolated bacteriophage of the invention, e.g., encapsulation in liposomes, microparticles, or microcapsules. Methods of introduction can be enteral or parenteral and include but are not limited to intradermal, intramuscular, intraperitoneal, intravenous, subcutaneous, intranasal, epidural, topical and oral routes. The polypeptide or the bacteriophage of the invention may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. Pulmonary administration can also be employed, e.g., by use of an inhaler or nebulizer, and formulation with an aerosolizing agent. In a specific embodiment, it may be desirable to administer the pharmaceutical compositions of the invention locally to the area in need of treatment, such as topical use on the skin; any suitable method known to the art may be used.

The invention further provides pharmaceutical compositions comprising one or more polypeptide of the invention or one or more bacteriophage of the invention for therapeutic use in treatment of infections caused by *K. pneumoniae*. Moreover, a further embodiment may include a pharmaceutical composition designed for use in topical or systemic treatment of the said infections. Another embodiment may include a pharmaceutical composition designed for use in treatment of the infections that are non-responsive to other antibiotics.

Such compositions comprise a therapeutically effective amount of one or more the polypeptides of the invention or one or more bacteriophage of the invention, and a pharmaceutically acceptable carrier. The term "carrier" refers to a diluent, adjuvant, excipient, or vehicle with which the therapeutic is administered. Such pharmaceutical carriers can be sterile liquids, such as water and oils, including those of petroleum, animal, vegetable or synthetic origin, such as peanut oil, soybean oil, mineral oil, sesame oil and the like. Water is a preferred carrier when the pharmaceutical composition is administered intravenously. Saline solutions and aqueous dextrose and glycerol solutions can also be employed as liquid carriers, particularly for injectable solutions. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. The composition, if desired, can also contain minor amounts of wetting or emulsifying agents, or pH buffering agents. These compositions can take the form of solutions, suspensions, emulsion, tablets, pills, capsules, powders, sustained-release formulations and the like. The composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, etc.

In a preferred embodiment, the composition is formulated in accordance with routine procedures as a pharmaceutical composition adapted for intravenous administration to human beings. Typically, compositions for intravenous administration are solutions in sterile isotonic aqueous buffer. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

Diagnostic or Detecting Uses

The invention further provides a method of diagnosing or detecting infection of one or more *K. pneumoniae* strain(s), comprising a) collecting a subject sample suspected of harboring *K. pneumoniae* strain(s); b) incubating the samples to form colonies; c) contacting the sample with one or more polypeptide of the invention or one or more bacteriophage of the invention with the colonies; and d) observing the colonies wherein the appearance of digestion zone of the colonies indicates the presence of *K. pneumoniae* strain(s) in the sample. In this context, the polypeptide of the invention or the bacteriophage of the invention will specifically lyse *K. pneumoniae* strain(s) without affecting any other prokaryotic or eukaryotic cells that may be present in the sample, thus providing means for accurately and specifically identifying and detecting *K. pneumoniae* strain(s). Accordingly, the infection of *K. pneumoniae* strain can be diagnosed.

Immunogen/Vaccine Development Uses

The capsular polysaccharides are known to be important to virulence and the development of protective immunity. Accordingly, the invention further provides a method of producing an immunogen to *K. pneumoniae* strain(s), comprising contacting one or more polypeptide of the invention with *K. pneumoniae* strain(s) to cleavage capsular polysaccharide (CPS) to obtain polysaccharide fragments as immunogen against *K. pneumoniae* strain. The invention also provides immune serum or antibodies raised in response to immunization with the oligosaccharide fragment of the invention and which are useful as reagents for detecting the presence of *K. pneumoniae* strain or as vaccines for conferring passive immunity.

As mentioned above, the polypeptide of the invention can degrade capsule of *K. pneumoniae* strain(s). These polypeptides may have glycosidase activity. It is believed that these capsular polysaccharides were responsible for inducing immune recognition of *K. pneumoniae* strain(s). The polysaccharide fragments prepared according to this invention are also useful for preparing various immuno reagents for use in immunoassays and separations of antibodies to *K. pneumoniae* strain(s). For example, for immunoassays the polysaccharide fragments may be immobilized either directly or through a protein linker to a solid support. The solid support can then be used in various immunoassay systems known to those in the art including radioimmuno and ELISA assays to detect the presence of antibodies to *K. pneumoniae* strain(s). Such assays may be used to diagnose the presence of infection in individuals by assaying for the presence of antibody against *K. pneumoniae* strain(s) in serum.

For use in separation chemistry, the polysaccharide fragments may be immobilized to a solid support to prepare an affinity column. Methods of coupling protein to affinity columns are known to those skilled in the art. Common supports for affinity columns are prepared from agarose and are commercially available, e.g. activated Sepharose (Pharmacia). Such affinity columns may then be used for separating *K. pneumoniae* strain antibodies from sources such as serum. Antibody may then be separated from serum by combining the immobilized polysaccharide fragments with serum suspected of containing *K. pneumoniae* strain antibodies under conditions which allow for antibodies to bind to immobilized fragments. The bound antibody may then either be detected using conventional assay techniques, or separated and recovered from the polysaccharide fragment following separation of the remaining serum components from the immobilized support.

EXAMPLE

Example 1

Isolation of Phages that Infected *K. pneumoniae* PLA Strain NTUH-K2044 Bacterial Strains The *K. pneumoniae* strains were isolated from the blood of patients from National Taiwan University Hospital. One Canadian-isolated K1 strain causing PLA was provided by Dr. Yoav Keynan of the Department of Medical Microbiology, University of Manitoba, Winnipeg, Manitoba, Canada. One K1 strain isolated in Belgium causing PLA and metastatic endophthalmitis was provided by Dr. Francois Willermain of the Department of Ophthalmology, University Libre de Bruxelles, Bruxelles, Belgium. One K1 strain from the USA which caused PLA was provided by Dr. Joseph Rahimian of School of Medicine, New York University, New York. *K. pneumoniae* 77 capsular serotype reference strains were purchased from Statens Serum Institute, Copenhagen, Denmark and *K. pneumoniae* strain A5054 causing human pneumonia was the reference strain of serotype K1. Three strains (ATCC8045, ATCC8047 and ATCC35593) purchased from the American Type Culture Collection (ATCC) were determined as serotype K1 and were also used in this study.

Phage Isolation

Phages that infected *K. pneumoniae* NTUH-K2044 strain were isolated from untreated water. *K. pneumoniae* NTUH-K2044 strain was co-cultured with untreated water in LB broth overnight. After centrifugation, the supernatant filtrated by 0.45 μm filter was spotted on LB plates overlaid with *K. pneumoniae* NTUH-K2044 strain to detect phage activity. Agar overlay method was used for isolation of a pure phage preparation and titer determination of the phage.

Figure 2:
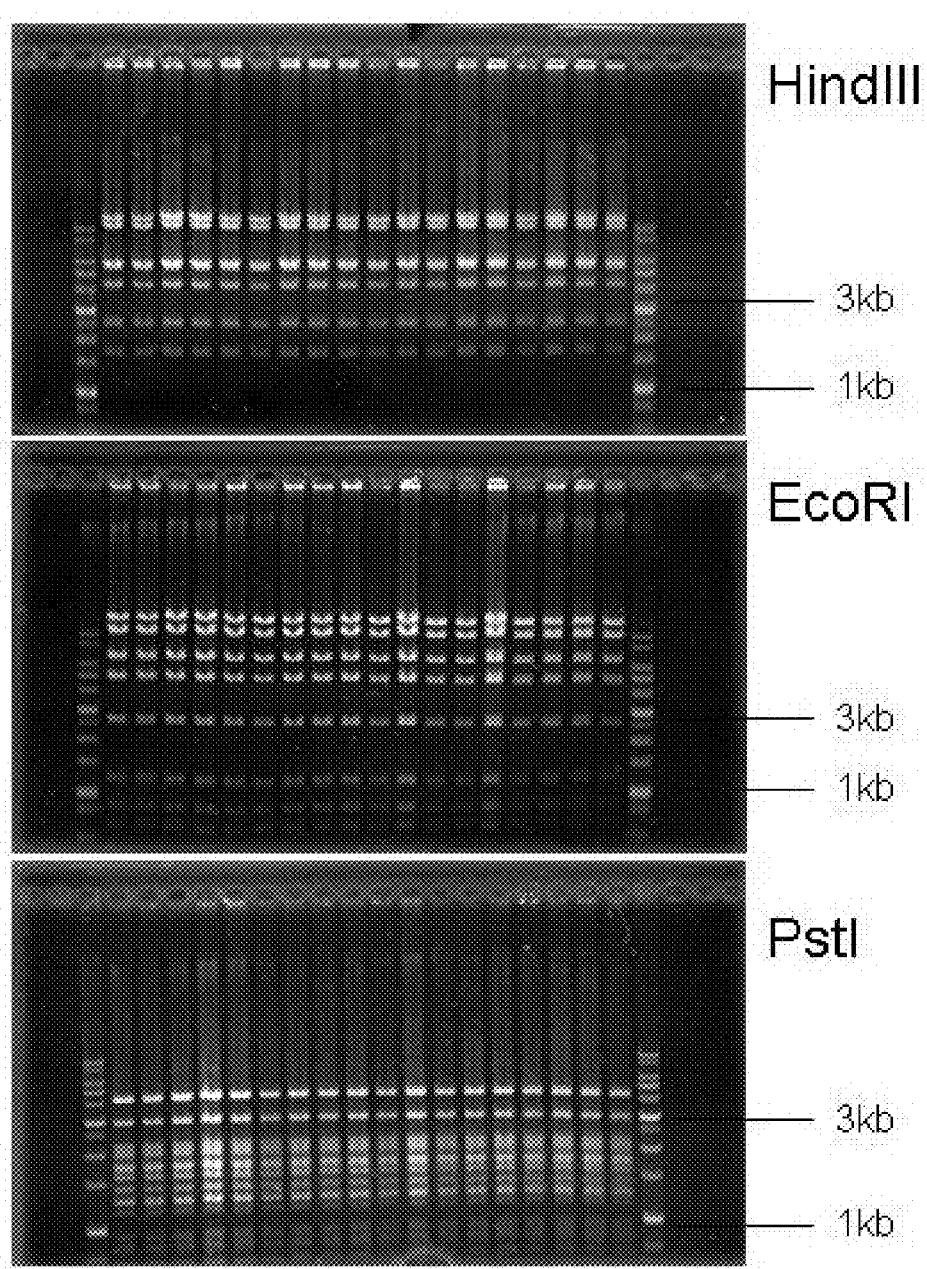
FIG. 2 shows the patterns of restriction fragments (HindIII, EcoRI and PstI) of genome of 18 isolated K1 bacteriophage clones.

Plaques were observed in the culture medium filtrated with 0.45 μm filters incubated with *K. pneumoniae* NTUH-K2044 strain (FIG. 1). Eighteen potential phages were isolated and their genome extracted and digested with restriction enzymes (HindIII, EcoRI and PstI). The patterns of restriction fragments were indistinguishable among 18 bacteriophage clones; therefore, these phages were considered identical and the genome of this phage was double-stranded DNA with predicted size of approximately 40 kb (FIG. 2).

Morphology of this Bacteriophage

Figure 3:
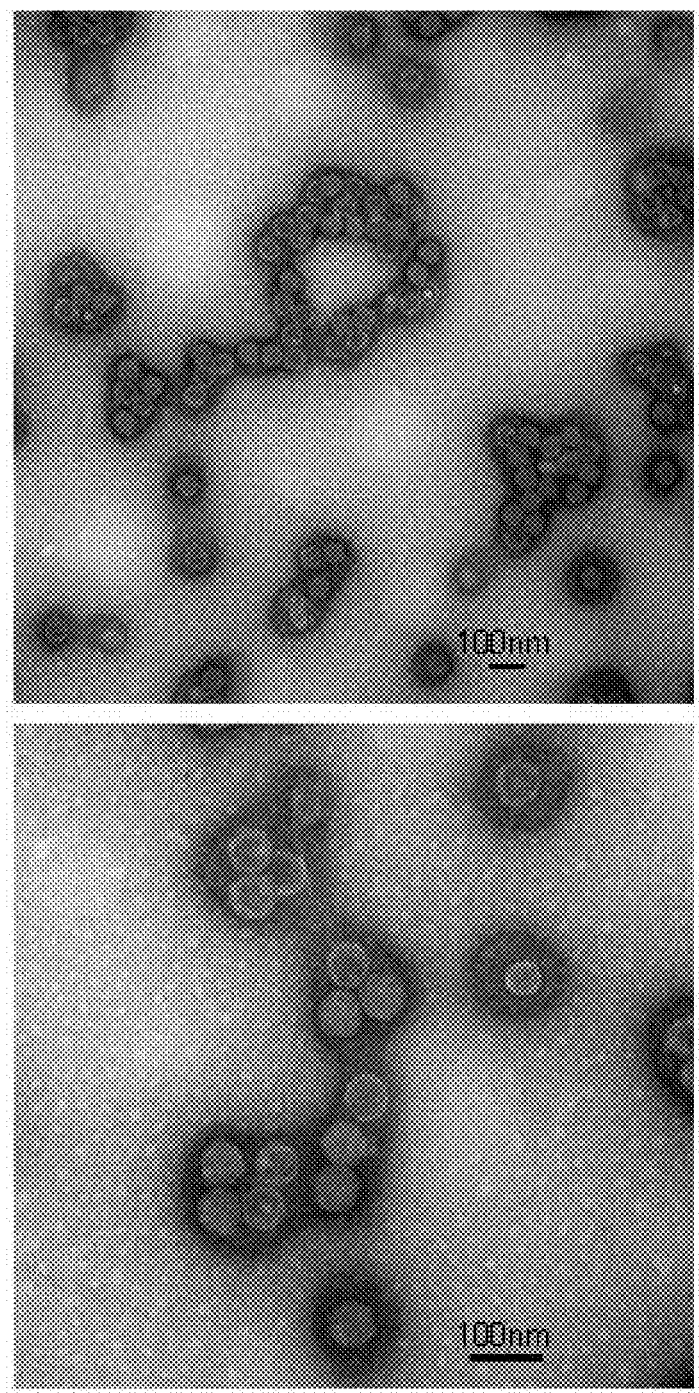
FIG. 3 shows the morphology of K1 phage.

The morphology of this phage was observed by transmission electron microscope. The phage has an isometric head and a short tail (FIG. 3). According to the morphology observed under electron microscope, this phage might belong to Order Caudovirales, Family Podoviridae.

Host Spectrum of this Bacteriophage

Figure 4:
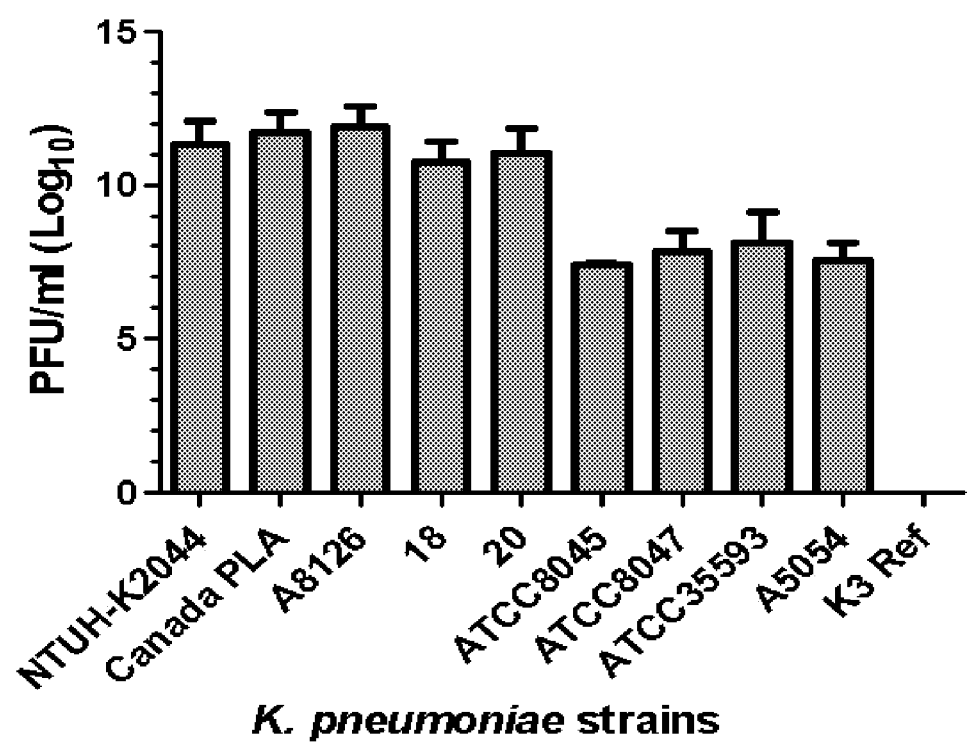
FIG. 4 shows the infectivity of phage φK1-1 among different capsular type strains.

The host range of this bacteriophage was determined by spot test in 23 capsular type K1 strains, including 15 isolates from Taiwan and 8 isolates from the USA, Canada, Belgium and Japan as well as 82 non-capsular type K1 strains including all non-capsular type K1 reference strains (Table 1). The infectivity of this phage to two *E. coli* strains, DH10B and ATCC25922, was also determined Spot test results revealed that this phage specifically infected strains with K1 capsular type but not those with the remaining 76 capsular types or N1 type. Therefore, this phage was named φK1-1. The infectivity of phage φK1-1 was compared with that of different capsular type K1 strains by plaque tittering assay. The amount of plaque was calculated after phage φK1-1 infected different capsular type K1 strains. The infectivity of phage φK1-1 to five strains isolated from patients with PLA was significantly higher than that to four strains collected from ATCC; capsular type K3 reference strain served as negative control (FIG. 4).

Infectivity of Phage φK1-1 in a Non-Capsulated Mutant

Because phage φK1-1 specifically infected capsular type K1 strains, we further examined whether capsule was essential for infection of phage φK1-1. The infectivity of phage φK1-1 to a non-capsulated mutant described previously, magA deletion mutant, was determined by spot test. The magA deletion mutant could not be infected with phage φK1-1, whereas the parental NTUH-K2044 strain could be lysed by this phage.

Example 2

Cloning of ORF33 Protein and its Sensitivity and Specificity to Capsular Type K1 Strains Phage Genomic DNA Preparation Phage genomic DNA was extracted per Qiagen Lamda kit with modifications. After phages were precipitated and lysed, the phage DNA was extracted by phenol/chloroform and then precipitated by ethanol.

Protein Expression and Purification

The orf33 gene (i.e., the polynucleotide having the sequence of SEQ ID NO: 1) was amplified by PCR using primers orf33+2-F (5'-CAATGGCATTAATTAGATTAG-3'; SEQ ID NO: 123) and orf33+2-R (5'-GAGAGATATAC-CTCCCAGGCC-3'; SEQ ID NO: 124). Then the PCR product was cloned into a pGEM-T easy plasmid (Promega) and the direction of orf33 was opposite to that of lacZ in the resulted plasmid. The orf33-pGEM-T easy plasmid was digested by NotI and orf33 fragment was cloned into the NotI site of pET28c plasmid (Novagen). The resulted orf33-pET28c plasmid was transformed into *E. coli* BL21(DE3). The recombinant His-tag ORF33 protein was expressed under 0.1 mM IPTG induction at 25° C. for 4 hours and then purified by nickel beads per manufacturer's protocol (Qiagen).

Full Genome of Phage φK1-1

Figure 5:
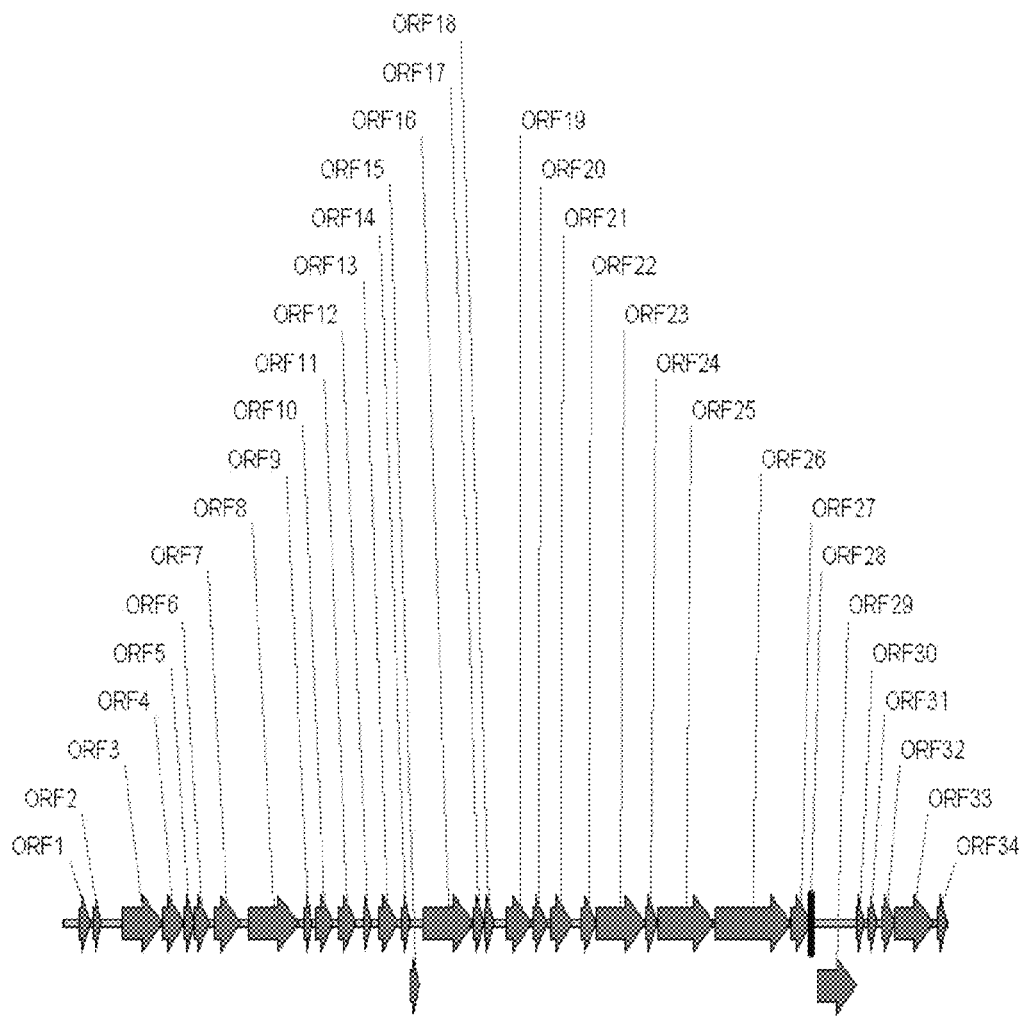
FIG. 5 shows the genome of phage φK1-1.

The full genome of bacteriophage φK1-1 was sequenced by using next generation sequencing method and the 5' and 3' ends were finished by inverse PCR and Sanger's sequencing. The genome of bacteriophage φK1-1 was 43872 base-pairs in length and was predicted to contain 34 open-reading frames (ORF) with same direction (FIG. 5). The genome of phage φK1-1 was flanked with 234 base-pair direct-repeat sequences in 5' and 3' ends. The amino-acid sequences of bacteriophage φK1-1 showed similarity to those of *Klebsiella* phage KP34 and *Vibrio* phage VP93. The results of sequences supported the morphological observation that bacteriophage φK1-1 belongs to Order Caudovirales, Family Podoviridae.

Capsule Depolymerization by Bacteriophage φK1-1

Figure 6:
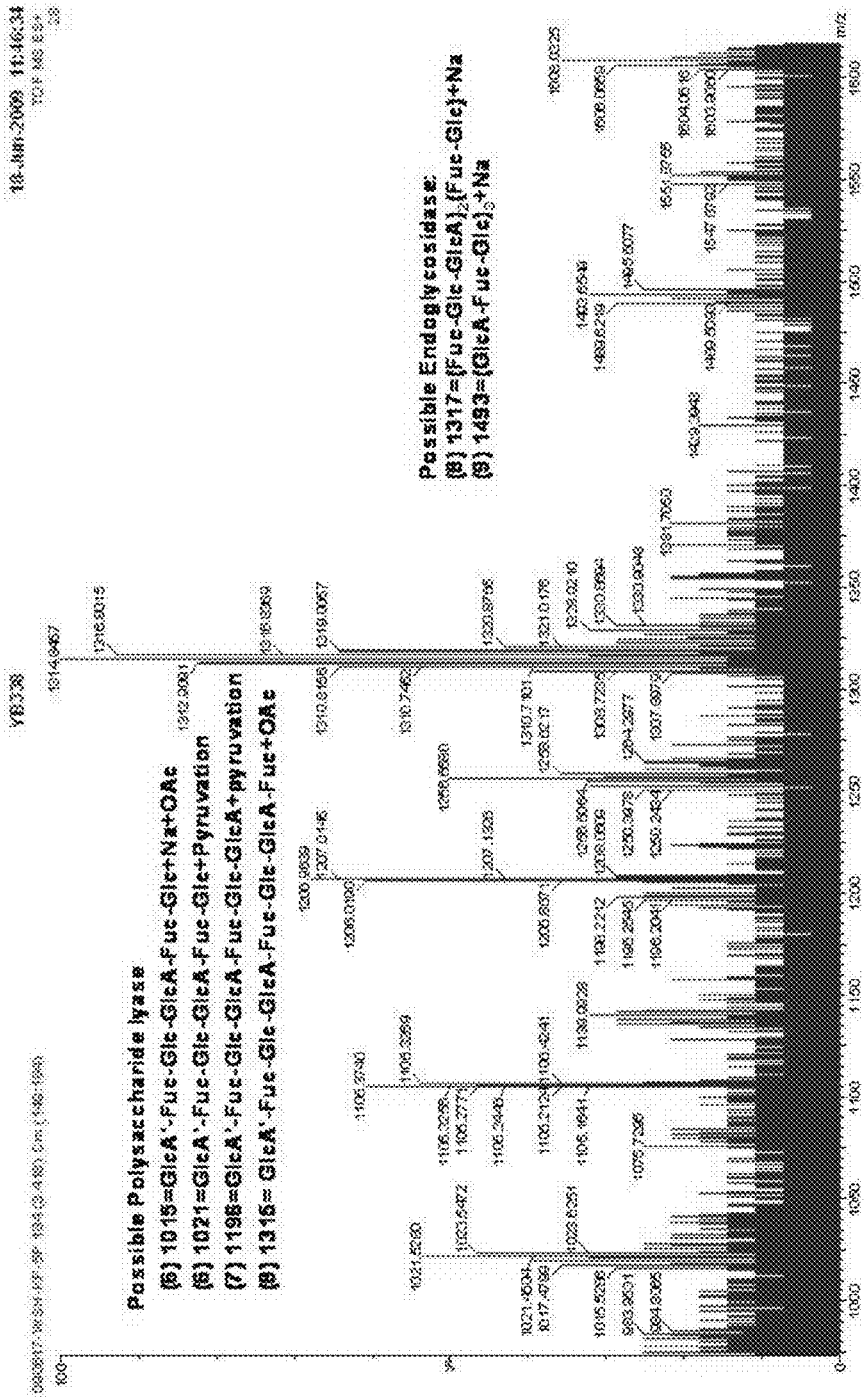
FIG. 6 shows MS spectra of the hydrolyzed CPS by the phage φK1-1, which shows intact acetylation and pyruvation after effective depolymerization.

The repeating units of the trisaccharide of K1 capsular polysaccharide (CPS) were resolved as [→3]-β-D-Glc-(1→4)-[2,3-(S)-pyruvate]-β-D-GlcA-(1→4)-α-L-Fuc-(1→) with the unusual feature of extensive pyruvation of glucuronic acid and acetylation of $C_2$—OH or $C_3$—OH of fucose. The isolated *K. pneumoniae* NTUH-K2044 CPS was incubated with phage φK1-1 and the hydrolyzed products were separated by FPLC and analyzed by mass-spectra. The mass-spectra showed that the proposed oligosaccharides might be obtained from carbohydrate lyase in a beta-elimination, and from endoglycosidase (FIG. 6). The modification of either pyruvation or acetylation remained intact after reaction. The sugar units of CPS were distributed from six to nine.

Cloning and Expression of Putative Capsule Depolymerase

Figure 7:
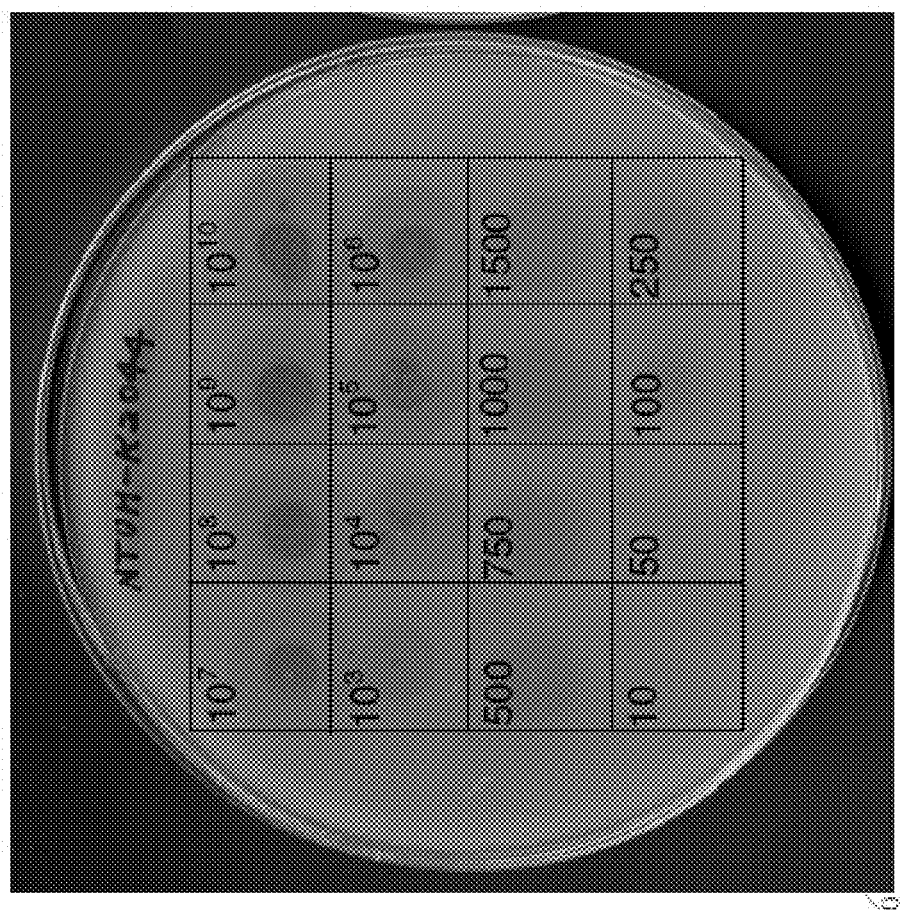
FIG. 7 shows NTUH-K2044 strain treated with phage NTUH-K2044-K1-1 ($10^3 \sim 10^{10}$ pfu/ml, 1 µl) and ORF33 polypeptide (10~1500 ng/µl, 1 µl).

Analysis of the ORFs of phage φK1-1 revealed that predicted ORF33 (i.e., the polypeptide having the sequence of SEQ ID NO: 2) was similar with a pectate lyase (identity 26%) and might be a putative CPS depolymerase. The His-tag ORF33 protein was cloned and expressed in *E. coli* as well as purified by nickel beads. The phage φK1-1 and recombinant ORF33 showed digestion zones in plates inoculated with *K. pneumoniae* capsular type K1 strains (FIG. 7). As shown in FIG. 7, NTUH-K2044 strains treated with 1 µl of $10^3 \sim 10^{10}$ pfu/ml of phage φK1-1 respectively exhibit clear zones and NTUH-K2044 strains treated with 1 µl of 10-1500 ng/µl of ORF33 polypeptide respectively exhibit semi-clear zones. The above results show that either phage φK1-1 or the ORF33 polypeptide thereof can effectively inhibit *K. pneumoniae* capsular type K1 strains. Although the infectivity of phage φK1-1 was different from that of other capsular type K1 strains, at least 100 ng recombinant ORF33 protein consistently revealed a digestion zone among these strains. Furthermore, the ORF33 protein same as phage φK1-1 also showed specificity to capsular type K1 strain (such as *K. pneumoniae* NTUH-K2044 strain). Sensitivity and specificity (phage φK1-1 or ORF33) are shown in Table A below.

TABLE A

|  |  | Phage φK1-1 or ORF33 detection | |
|---|---|---|---|
|  |  | + | − |
| *K. pneumoniae* strains | K1 | 23 | 0 |
|  | non-K1 | 0 | 82 |

Example 3

Isolation of Other Phages that Infected *K. Pneumoniae* Strains and their Specificity Bacterial Strains
Reference Strains:

*K. pneumoniae* 77 capsular serotype reference strains were purchased from Statens Serum Institute, Copenhagen, Denmark. An additional capsular type, KN1, identified in our previous study was also included. Strains were also purchased from the American Type Culture Collection (ATCC).

Clinical Isolates:

One hundred and six *K. pneumoniae* strains were isolated from the blood of patients from National Taiwan University Hospital (from 2001-2010). Seventy-nine blood isolates were obtained from the Department of Medical Microbiology, University of Manitoba, Winnipeg, Manitoba, Canada.

The capsular types of 185 blood isolates from Taiwan and Canada were tested with phage/glycosidase. The most prevalent capsular types in Taiwan were K1 (16/106, 15%), K2 (16/106, 15%) and K54 (7/106, 6.6%), while K25 (5/79, 6.3%), K2 (4/79, 5%) and K10 (4/79, 5%) were most common in Canada (Table B).

A total of 118 *K. pneumoniae* strains with documented capsular types including K1, K2, K5, K7, K8, K9, K10, K14, K16, K20, K23, K39, K49, K52, K54, K55, K56, K57, K58, K62, K81 and KN1 by the predicted wzy cps-PCR genotyping were used for comparison between phage typing and serotyping.

TABLE B prevalence rates of capsular types of *K. pneumoniae* bacteremia strains from NTUH and Canada

| Capsular type | No. of Canada strains (79) | No. of NTUH strains (106) | Total (185) |
|---|---|---|---|
| K2[a] | 4 (5%) | 16 (15%) | 20 |
| K1 | 0 | 16 (15%) | 16 |
| K54 | 3 | 7 (6.6%) | 10 |
| K10 | 4 (5%) | 5 | 9 |
| K62 | 3 | 5 | 8 |
| K16 | 2 | 5 | 7 |
| K3 | 2 | 3 | 5 |
| K8 | 2 | 3 | 5 |
| K14 | 3 | 2 | 5 |
| K20 | 1 | 4 | 5 |
| K25 | 5 (6.3%) | 0 | 5 |
| K30 | 2 | 3 | 5 |
| K28 | 2 | 2 | 4 |
| K39 | 3 | 1 | 4 |
| K5 | 2 | 1 | 3 |
| K24 | 2 | 1 | 3 |
| K63 | 2 | 1 | 3 |
| KN1 | 1 | 2 | 3 |
| K7 | 2 | 0 | 2 |
| K13 | 0 | 2 | 2 |
| K22 | 2 | 0 | 2 |
| K23 | 1 | 1 | 2 |
| K27 | 1 | 1 | 2 |
| K29 | 2 | 0 | 2 |
| K35 | 2 | 0 | 2 |
| K44 | 0 | 2 | 2 |
| K49 | 2 | 0 | 2 |
| K52 | 1 | 1 | 2 |
| K12 | 1 | 0 | 1 |
| K18 | 1 | 0 | 1 |
| K40 | 0 | 1 | 1 |
| K43 | 1 | 0 | 1 |
| K46 | 0 | 1 | 1 |
| K48 | 0 | 1 | 1 |

TABLE B-continued prevalence rates of capsular types of *K. pneumoniae* bacteremia strains from NTUH and Canada

| Capsular type | No. of Canada strains (79) | No. of NTUH strains (106) | Total (185) |
|---|---|---|---|
| K51 | 0 | 1 | 1 |
| K57 | 0 | 1 | 1 |
| K60 | 0 | 1 | 1 |
| K61 | 0 | 1 | 1 |
| K81 | 0 | 1 | 1 |
| K82 | 1 | 0 | 1 |
| Unknown (probably new) | 19 | 14 | 33 |

[a]K2 stains which reacted to K2 and K13 phage were confirmed by cps-PCR genotyping Phage Isolation Phages infected reference or clinical *K. pneumoniae* strains were isolated from untreated water. *K. pneumoniae* strains were co-cultured with untreated water in LB broth overnight. After centrifugation, the supernatant filtrated by 0.45 µm filter was spotted on LB plates overlaid with the *K. pneumoniae* host strain to detect phage activity. Agar overlay method was used for isolation of a pure phage preparation and titer determination of the phage. These phages are designated as NTUH-K2044-1, A4528-K2-1, A44-K5-1, ref-K51-1, A13-K20-1, ref-K37-1, ref-K2-1, ref-K3-1, ref-K5-2, ref-K9-1, ref-K10-1, ref-K11-1, ref-K11-2, ref-K19-1, ref-K21-1, ref-K22-1, ref-K23-1, ref-K27-1, ref-K35-1, ref-K39-1, ref-K42-1, ref-K45-1, ref-K47-1, 0417-K52-1, A 1365-K54-1, ref-K57-1, ref-K63-1, ref-K64-1, ref-K65-1, -K28-1, ref-K33-1, ref-K34-1, ref-K41-1, ref-K44-1 and ref-K72-1.

Phage Genomic DNA Sequencing

Phage genomic DNA was extracted per Qiagen Lamda kit (Qiagen, Valencia, Calif.) with modifications. After phages were precipitated and lysed, the phage DNA was extracted by phenol/chloroform and then precipitated by ethanol. Genomic sequencing was performed by Next Generation Sequencing (YMGC, Yang-Ming Genome Research Center High-throughput Genome Analysis Core and BGI, Beijing Genomics Institute). For example, the full genomes of NTUH-K2044-1, A4528-K2-1, A44-K5-1 and A13-K20-1 are shown in SEQ ID NOs: 97 to 100, respectively.

Expression and Purification of the Polypeptides of Glycosidases of the Invention Putative glycosidases encoding genes were identified by amino acid sequences comparison. They were then amplified by PCR using primers covering the flanking regions of both ends. For example, the orf33 gene of K1-1 phage was amplified by PCR using primers orf33+2-F (5'-CAATG-GCATTAATTAGATTAG-3'; SEQ ID NO: 123) and orf33+2-R (5'-GAGAGATATACCTCCCAGGCC-3'; SEQ ID NO: 124). Then PCR products were then cloned into a pGEM-T easy plasmid (Promega, Madison, USA) and the direction of orf33 was opposite to that of lacZ in the resulted plasmid. The orf33-pGEM-T easy plasmid was digested by NotI and orf33 fragment was cloned into the NotI site of pET28c plasmid (Novagen, Madison, USA). The resulted orf33-pET28c plasmid was transformed into *E. coli* BL21(DE3). The recombinant His-tag ORF33 protein was expressed under 0.1 mM IPTG induction at 25° C. for 4 hours and then purified by nickel beads per manufacturer's protocol (Qiagen). The polypeptides of the glycosidases obtained from NTUH-K2044-K1-1, A4528-K2-1, ref-K2-1, ref-K3-1, A44-K5-1, ref-K5-2, ref-K9-1, ref-K10-1, ref-K11-1, ref-K11-2, ref-K19-1, ref-K21-1, ref-K22-1, ref-K23-1, ref-K27-1, ref-K35-1, ref-K39-1, ref-K42-1, ref-K45-1, ref-K47-1, ref-K51-1, 0417-K52-1, A1365-K54-1, ref-K57-1, ref-K63-1, ref-K64-1, ref-K65-1, -K28-1, ref-K33-1, ref-K34-1, ref-K41-1, ref-K44-1, ref-K72-1 and their size (bp) and their specificity to capsule type of *K. pneumoniae* are listed in Table C.

TABLE C

The polypeptides for digestion of capsule polysaccharides of *K. pneumoniae*.

| phage (capsule type of host) | size (bps) of polypeptide | Specificity to capsule type of *K. pneumoniae* |
|---|---|---|
| NTUH-K2044-K1-1 (1) | 1953 | K1 |
| A4528-K2-1 (2, 13) | 1731 | K2/K13 |
| ref-K2-1 (1, 2, 8, 13, 58) | 3279 | K58 |
| ref-K3-1 (3) | 2196 | K3 |
| A44-K5-1 (5, 8) | 2052 | K5 |
| A44-K5-1 (5, 8) | 2247 | K8 |
| ref-K5-2 (5, 24, 30, 38, 40, 52, 69) | 2376 | K30/K69 |
| ref-K9-1 (9) | 1692 | K9 |
| ref-K10-1 (10, 62) | 1839 | K62 |
| ref-K11-1 (11, 57) | 2625 | K11 |
| ref-K11-2 (1, 11, 21, 25, 30, 35, 64, 65, 69) | 1752 | K25 |
| ref-K19-1 (10, 19, 36, 43, 56, 68, 57) | 1974 | K10 |
| ref-K19-1 (10, 19, 36, 43, 56, 68, 57) | 1962 | K19 |
| ref-K19-1 (10, 19, 36, 43, 56, 68, 57) | 1983 | K36 |
| ref-K19-1 (10, 19, 36, 43, 56, 68, 57) | 2256 | K56 |
| ref-K21-1 (6, 21, 22, 31, 35, 43, 48, 57, 63, 68) | 2133 | K21 |
| ref-K21-1 (6, 21, 22, 31, 35, 43, 48, 57, 63, 68) | 2178 | K31 |
| ref-K21-1 (6, 21, 22, 31, 35, 43, 48, 57, 63, 68) | 1887 | K48 |
| ref-K22-1 (22) | 2340 | K22 |
| ref-K23-1 (23, 38) | 3501 | K38 |
| ref-K27-1 (7, 20, 27) | 3540 | K7 |
| ref-K27-1 (7, 20, 27) | 3882 | K27 |
| ref-K35-1 (31, 34, 35) | 2133 | K35 |
| Ref-K39-1 (11, 20, 39, 49, KN1) | 2005 | K39 |
| ref-K42-1 (42) | 2604 | K42 |
| ref-K45-1 (45) | 2499 | K45 |
| ref-K47-1 (47) | 2007 | K47 |
| ref-K51-1 (14, 51) | 2670 | K51 |
| 0417-K52-1 (9, 49, 50, 52, 60, 63) | 2160 | K52 |
| A1365-K54-1 (54) | 1761 | K54 |
| ref-K57-1 (57, 68) | 3816 | K57 |
| ref-K63-1 (63) | 1890 | K63 |
| ref-K64-1 (64) | 3051 | K64 |
| ref-K65-1 (65) | 2409 | K65 |
| ref-K66-1 (66) | 2337 | K66 |
| ref-K68-1 (20, 57, 66, 68) | 1710 | K68 |
| ref-K82-1 (82) | 1914 | K82 |
| A1517-KN1-1 (N1) | 2460 | KN1 |
| 0507-KN2-1 (N2) | 3735 | KN2 |
| ref-K17-1 (17) | 2469 | K17 |
| ref-K24-1 (24) | 1749 | K24 |
| ref-K26-1 (26) | 921 | K26 |
| YD8-K28-1 (28) | 1689 | K28 |
| ref-K33-1 (33) | 2157 | K33 |
| ref-K34-1 (34) | 2406 | K34 |
| ref-K41-1 (41) | 2391 | K41 |
| ref-K44-1 (24, 44, 45) | 2904 | K44 |
| ref-K72-1 (72) | 1785 | K72 |

Serotyping by Double Immunodiffusion and Immunoblot

The 77 K-serotypes antisera were purchased from Statens Serum Institute, Copenhagen, Denmark. The specific K2 antiserum was generated by immunizing rabbits with the wbbO deletion mutant (O-antigen deficient) of A4528 (K2, O1). The antiserum which specifically recognized O1 antigen was generated by immunizing mice with the magA deletion mutant of NTUH-K2044 (K1, O1).

Double immunodiffusion assay were performed as previously described. In brief, approximately $4 \times 10^9$ bacteria harvested to extract capsule were exposed to serotype-specific antiserum. A comparison of sensitivity between phage/glycosidase typing and serotyping is shown in Table D.

TABLE D

A comparison of sensitivity between phage/glycosidase typing and serotyping

| | Reactivity (positive/total) | | |
| --- | --- | --- | --- |
| | Phage/Enzyme | Serotyping | |
| Capsular type | sensitivity | DID | Immunoblot |
| K1 | 23/23 | 23/23 | — |
| K2 | 11/11 | 0/11 | 11/11, React to O antigen, not K antigen |
| K5 | 6/6 | 0/6 | 6/6 |
| K7 | 3/3 | 0/3 | 3/3, React to O antigen, not K antigen |
| K8 | 4/4 | 3/4 | — |
| K9 | 3/3 | 3/3 | — |
| K10 | 2/2 | 1/2 | — |
| K14 | 2/2 | 2/2 | — |
| K16 | 5/5 | 5/5 | — |
| K20 | 3/3 | 2/3 | — |
| K23 | 6/6 | 0/6 | 6/6 |
| K39 | 2/2 | 2/2 | — |
| K49 | 2/2 | 2/2 | — |
| K52 | 3/3 | 3/3 | — |
| K54* | 8/10 | 8/10 | — |
| K55 | 4/4 | 0/4 | 4/4 |
| K56 | 4/4 | 4/4 | — |
| K57 | 9/9 | 1/9 | — |
| K58 | 5/5 | 0/5 | 5/5 |
| K62 | 3/3 | 3/3 | — |
| K81** | 2/3 | 2/3 | — |
| KN1 | 2/2 | 2/2 | — |
| N2 | 3/3 | 3/3 | — |

DID, Double immunodiffusion
*additional 2 phage/enzyme, were needed to identify all 10 strains
**additional one phage/enzyme, was needed to identify all 3 strains
Sensitivity of phage typing v.s. serotyping (Double immunodiffusion) = 115/118(97%) v.s. 69/118(58%)

Immunoblot were performed as the following procedure. Ten μL of each capsular extract were vacuum spotted onto a nitrocellulose membrane by means of a dot or slot blot device. The membrane was overlapped with a piece of filter and both were rinsed with Western transfer buffer containing 47.8 mM Tris, 38.6 mM glycine, 20% MeOH, and 0.037% sodium dodecyl sulfate. The membrane was dried and non-specific sites were blocked by soaking in 1× phosphate buffered saline with 0.5% Tween 20 (PBST) plus 5% milk for 1 h at room temperature. The membrane was then incubated with serotype-specific antiserum purchased from Statens Serum Institute as primary antibody (1:5000 dilution for antiserum) dissolved in PBST plus milk at 4° C. overnight, washed four times with PBST for 10 min each, incubated with secondary antibody conjugated with horseradish peroxidase (goat anti-rabbit IgG-HRP, 1:10000) for 1 h at room temperature, and washed three times with PBST for 10 min each. ECL reagent was added for 3 min and the membrane was exposed to X-ray film in the dark room.

Phage/Glycosidase Typing

Phage/glycosidase typing was done by spot test. 15 cm diameter LB agar plates (35 g/liter) were overlaid with top agar (7 g/liter) which was inoculated with 200 μl of a fresh culture of bacteria. One μL of 78 phages or glycosidase was spotted on the plate by eight-channel micro-pipetter after the top agar with plating bacteria solidified. The polypeptides (i.e., glycosidase) of the phages of the invention specific to digest *K. pneumoniae* strains are shown in Table E below and the gray blocks indicate the specificity. We isolated more than 200 strains of phages which infected the 78 capsular types of *K. pneumoniae* strains. Among them, 78 phages that could differentiate the 78 capsular types were selected for capsular typing (see Table E below). There were 38 specific phages among the 78 phages which we have isolated showed a very high specificity when testing the 77 reference strains and KN1 strain. For example, phage NTUH-K2044-K1-1 infected all K1 strains of *K. pneumoniae*, but not non-K1 *K. pneumoniae* or other species. After sequencing the genomes of these phages, a total of 48 putative glycosidase of these phages were identified, 39 of them were cloned and expressed currently (see Table C). All recombinant glycosidases showed capsule degrading specificity in consistency with the original phages that infect the same capsular type of host. For example, K5 and K8 glycosidase were characterized from the A44-K5-1 phage which infects K5 and K8 *K. pneumoniae*.

| | NTUH-K2044-K1-1 | A4528-K2-1 | ref-K3-1 | ref-K4-1 | ref-K5-1 | ref-K6-1 | ref-K7-1 | ref-K8-1 | ref-K9-1 | ref-K10-1 | ref-K11-1 | ref-K12-1 | ref-K13-1 | ref-K14-1 | ref-K15-1 | ref-K16-1 | ref-K17-1 | ref-K18-1 | ref-K19-1 | A13-K20-1 | ref-K21-1 | ref-K22-1 | ref-K23-1 | ref-K24-1 | ref-K25-1 | ref-K26-1 | ref-K27-1 | YD8-K28-1 |
|---|---|---|---|---|---|---|---|---|---|---|---|---|---|---|---|---|---|---|---|---|---|---|---|---|---|---|---|---|
| K1 | ■ | | | | | | | | | | | | | | | | | | | | | | | | | | | |
| K2 | | ■ | | | | | | | | | | | | | | | | | | | | | | | | | | |
| K3 | | | ■ | | | | | | | | | | | | | | | | | | | | | | | | | |
| K4 | | | | ■ | | | | | | | | | | | | | | | | | | | | | | | | |
| K5 | | | | | ■ | | | | | | | | | | | | | | | | | | | | | | | |
| K6 | | | | | | ■ | | | | | | | | | | | | | | | ■ | | | | | | | |
| K7 | | | | | | | ■ | | | | | | | | | | | | | | | | | | | | | |
| K8 | | | | | | | | ■ | | | | ■ | | | | | | | | | | | | | | | | |
| K9 | | | | | | | | | ■ | | | | | | | | | | | | | | | | | | | |
| K10 | | | | | | | | | | ■ | | | | | | | | | | | | | | | | | | |
| K11 | | | | | | | | | | | ■ | | | | | | | | | | | | | | | | | |
| K12 | | | | | | | | | | | | ■ | | | | | | | | | | | | | | | | |
| K13 | | ■ | | | | | | | | | | | ■ | | | | | | | | | | | | | | | |
| K14 | | | | | | | | | | | | | | ■ | | | | | | | | | | | | | | |
| K15 | | | | | | | | | | | | | | | ■ | | | | | | | | | | | | | |
| K16 | | | | | | | | | | | | | | | | ■ | | | | | | | | | | | | |
| K17 | | | | | | | | | | | | | | | | | ■ | | | | | | | | | | | |
| K18 | | | | | | | | | | | | | | | | | | ■ | | | | | | | | | | |
| K19 | | | | | | | | | | | | | | | | | | | ■ | | | | | | | | | |
| K20 | | | | | | | | | | | | | | | | | | | | ■ | | | | | | | | |
| K21 | | | | | | | | | | | | | | | | | | | | | ■ | | | | | | | |
| K22 | | | | | | | | | | | | | | | | | | | | | | ■ | | | | | | |
| K23 | | | | | | | | | | | | | | | | | | | | | | | ■ | | | | | |
| K24 | | | | | | | | | | | | | | | | | | | | | | | | ■ | | | | |
| K25 | | | | | | | | | | | | | | | | | | | | | | | | | ■ | | | |
| K26 | | | | | | | | | | | | | | | | | | | | | | | | | | ■ | | |
| K27 | | | | | | | | | | | | | | | | | | | | | ■ | | | | | | ■ | |
| K28 | | | | | | | | | | | | | | | | | | | | | | | | | | | | ■ |

-continued

| | NTUH-K2044-K1-1 | A4528-K2-1 | ref-K3-1 | ref-K4-1 | ref-K5-1 | ref-K6-1 | ref-K7-1 | ref-K8-1 | ref-K9-1 | ref-K10-1 | ref-K11-1 | ref-K12-1 | ref-K13-1 | ref-K14-1 | ref-K15-1 | ref-K16-1 | ref-K17-1 | ref-K18-1 | ref-K19-1 | A13-K20-1 | ref-K21-1 | ref-K22-1 | ref-K23-1 | ref-K24-1 | ref-K25-1 | ref-K26-1 | ref-K27-1 | YD8-K28-1 |
|---|---|---|---|---|---|---|---|---|---|---|---|---|---|---|---|---|---|---|---|---|---|---|---|---|---|---|---|---|
| K29 | | | | | | | | | | | | | | | | | | | | | | | | | | | | |
| K30 | | | | | | | | | | | | | | | | | | | | | | | | | | | | |
| K31 | | | | | | | | | | | | | | | | | | | | | ■ | | | | | | | |
| K32 | | | | | | | | | | | | | | | | | | | | | | | | | | | | |
| K33 | | | | | | | | | | | | | | | | | | | | | | | | | | | | |
| K34 | | | | | | | | | | | | | | | | | | | | | | | | | | | | |
| K35 | | | | | | | | | | | | | | | | | | | | | ■ | | | | | | | |
| K36 | | | | | | | | | | | | | | | | | | | ■ | | | | | | | | | |
| K37 | | | | | | | | | | | | | | | | | | | | | | | | | | | | |
| K38 | | | | | | | | | | | | | | | | | | | | | | | ■ | | | | | |
| K39 | | | | | | | | | | | | | | | | | | | | | | | | | | | | |
| K40 | | | | | | | | | | | | | | | | | | | | | | | | | | | | |
| K41 | | | | | | | | | | | | ■ | | | | | | | | | | | | | | | | |
| K42 | | | | | | | | | | | | | | | | | | | | | | | | | | | | |
| K43 | | | | | | | | | | | | | | | | | | | ■ | | ■ | | | | | | | |
| K44 | | | | | | | | | | | | | | | | | | | | | | | | | | | | |
| K45 | | | | | | | | | | | | | | | | | | | | | | | | | | | | |
| K46 | | | | | | | | | | | | | | | | | | | | | | | | | | | | |
| K47 | | | | | | | | | | | | | | | | | | | | | | | | | | | | |
| K48 | | | | | | | | | | | | | | | | | | ■ | | | ■ | | | | | | | |
| K49 | | | | | | | | | | | | | | | | | | ■ | | | | | | | | | | |
| K50 | | | | | | | | | | | | | | | | | | | | | | | | | | | | |
| K51 | | | | | | | | | | | | | | | | | | | | | | | | | ■ | | | |
| K52 | | | | | | | | | | | | | | | | | | | | | | | | | | | | |
| K53 | | | | | | | | | | | | | | | | | | | | | | | | | | | | |
| K54 | | | | | | | | | | | | | | | | | | | | | | | | | | | | |
| K55 | | | | | | | | | | | | | | | | | | | ■ | | | | | | | | | |
| K56 | | | | | | | | | | | | | | | | | | | | | | | | | | | | |

-continued

| | NTUH-K2044-K1-1 | A4528-K2-1 | ref-K3-1 | ref-K4-1 | ref-K5-1 | ref-K6-1 | ref-K7-1 | ref-K8-1 | ref-K9-1 | ref-K10-1 | ref-K11-1 | ref-K12-1 | ref-K13-1 | ref-K14-1 | ref-K15-1 | ref-K16-1 | ref-K17-1 | ref-K18-1 | ref-K19-1 | A13-K20-1 | ref-K21-1 | ref-K22-1 | ref-K23-1 | ref-K24-1 | ref-K55-1 | ref-K26-1 | ref-K27-1 | YD8-K28-1 |
|---|---|---|---|---|---|---|---|---|---|---|---|---|---|---|---|---|---|---|---|---|---|---|---|---|---|---|---|---|
| K57 | | | | | ■ | | | | | | ■ | | | | | | | | ■ | | ■ | | | | | | | |
| K58 | | | | | | | | | | | | | | | | | | | | | | | | | | | | |
| K59 | | | | | | | | | | | | | | | | | | | | | | | | | | | | |
| K60 | | | | | | | | | | | | | | | | | | | | | | | | | | | | |
| K61 | | | | | | | | | | | | | | | | | | | | | | | | | | | | |
| K62 | | | | | | | | | | ■ | | | | | | | | | | | ■ | | | | | | | |
| K63 | | | | | | ■ | | | | | | | | | | | | | | | | | | | | | | |
| K64 | | | | | | | | | | | | | | | | | | | | | | | | | | | | |
| K65 | | | | | | | | | | | | | | | | | | | | | | | | | | | | |
| K66 | | | | | | | | | | | | | | | | | | | | | | | | | | | | |
| K67 | | | | | | | | | | | | | | | | | | | | | | | | | | | | |
| K68 | | | | | | | | | | | | | | | | | | | ■ | | ■ | | | | | | | |
| K69 | | | | | | | | | | | | | | | | | | | | | | | | | | | | |
| K70 | | | | | | | | | | | | | | | | | | | | | | | | | | | | |
| K71 | | | | | | | | | | | | | | | | | | | | | | | | | | | | |
| K72 | | | | | | | | | | | | | | | | | | | | | | | | | | | | |
| K74 | | | | | | | | | | | | | | | | | | | | | | | | | | | | |
| K79 | | | | | | | | | | | | | | | | | | | | | | | | | | | | |
| K80 | | | | | | | | | | | | | | | | | | | | | | | | | | | | |
| K81 | | | | | | | | | | | | | | | | | | | | | | | | | | | | |
| K82 | | | | | | | | | | | | | | | | | | | | | | | | | | | | |
| N1 | | | | | | | | | | | | | | | | | | | | | | | | | | | | |
| N2 | | | | | | | | | | | | | | | | | | | | | | | | | | | | |

Example 4

Protection Study of NTUH-K2044-K1-1 Phage Against *K. Pneumoniae* NTUH-K2044

Protection Study (Intra-Gastrical):

Five-week-old female BALB/cByl mice were inoculated intragastrically with $1\times10^9$ PFU of the NTUH-K2044-K1-1 phage, before or after 1 hour of *K. pneumoniae* NTUH-K2044 intragastrical inoculation ($1.7\times10^6$ CFU, 6 mice per group). Age-matched, no phage inoculation control mice were inoculated intragastrically with $1.7\times10^6$ CFU of the NTUH-K2044 (12 mice). Phage treatment mice and no phage treatment control mice were observed for 42 days for mortality and clinical signs. Survival was analyzed by Kaplan-Meier analysis with a log-rank test; a P value <0.05 was considered to be statistically significant.

Figure 8:
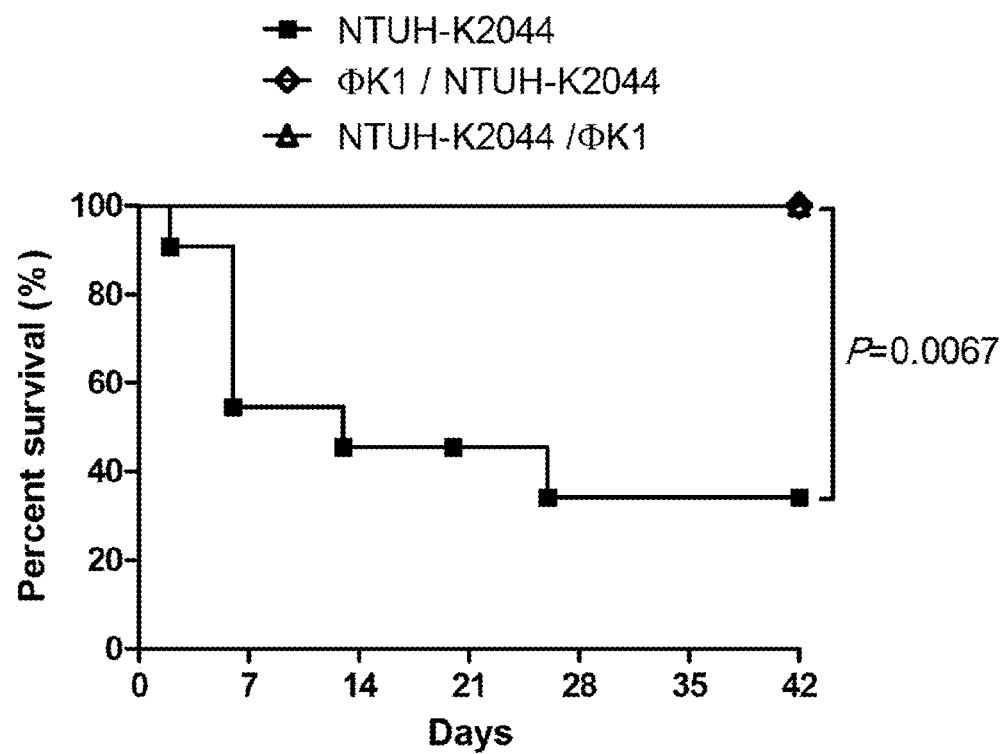
FIG. 8 shows the protection study (intra-gastrical) of ntuh-k2044-k1-1 phage against *k. pneumoniae* ntuh-k2044.

The treatment of NTUH-K2044-K1-1 phage before and after 1 hour of *K. pneumoniae* NTUH-K2044 intragastrical inoculation both significantly increased the survival rate (P=0.0067) (FIG. 8).

Protection Study (Intra-Peritoneal):

Five-week-old female BALB/cByl mice were inoculated intraperitoneally with $1\times10^8$ PFU of the NTUH-K2044-K1-1 phage, after 16 or 24 hours of *K. pneumoniae* NTUH-K2044 intraperitoneal inoculation ($1.3\times10^2$ CFU, 4 mice per group). Age-matched, no phage inoculation control mice were inoculated intraperitoneally with $1.3\times10^2$ CFU of the NTUH-K2044 (4 mice). Phage treatment mice and no phage treatment control mice were observed for 28 days for mortality and clinical signs. Survival was analyzed by Kaplan-Meier analysis with a log-rank test; a P value <0.05 was considered to be statistically significant.

Figure 9:
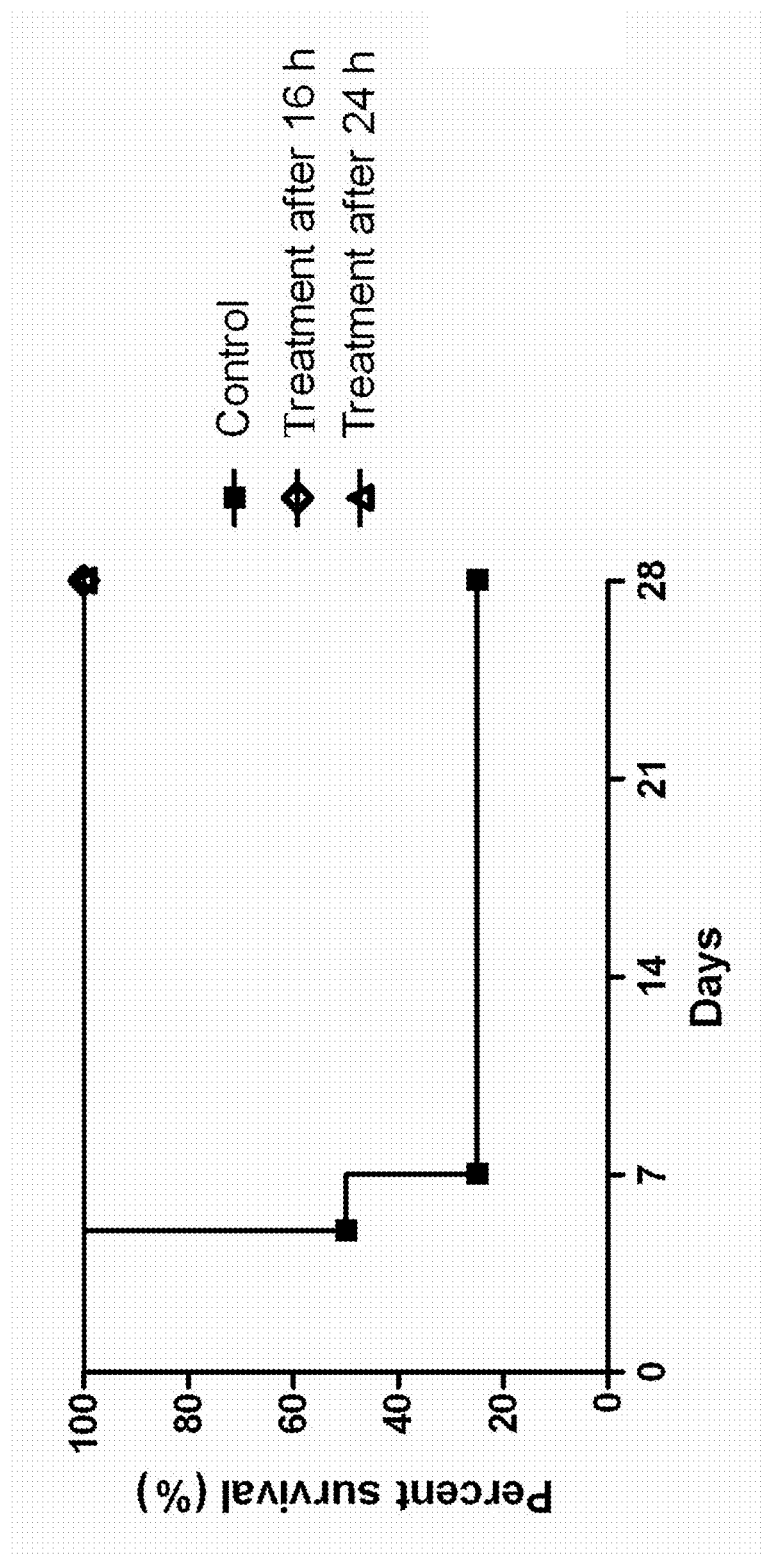
FIG. 9 shows the protection study (intra-peritoneal) of ntuh-k2044-k1-1 phage against *k. pneumoniae* ntuh-k2044.

The treatment of NTUH-K2044-K1-1 phage after 16 and 24 hours of *K. pneumoniae* NTUH-K2044 intraperitoneal inoculation both significantly increased the survival rate (P=0.0209) (FIG. 9).

---

SEQUENCE LISTING (102 sequences)

SEQ ID NO: 1 - DNA, 1953 bp, Artificial sequence
  specific to K1
atggcattaattagattagtagctcccgagcgggtgttctccgacttggcgagcatggtagcatacccaaactttcaggtgcaggacaagattaccctgctgggcagtgccggtggggatttcacctttactactactgcgtcggtagtggataacggaaccgtgtttgctgtacccggtgggtacctgctacgtaaattcgtgggtccagcatacagctcctggttcagcaactggacgggcatagtcacgttcatgagcgcgcctaataggcacctggttgtggacacggtcctgcaggccacgagtgtgctcaacatcaaaagcaactctacgctagagtttaccgataccggaagaatcctaccggatgctgcggttgcacgccaagtgcttaatattaccggctcggcaccctcggtgttcgtaccgttagcagcggatgccgcggcgggcagtaaagtcattacggtggctgctggggctttgtctgcggtaaaaggtacgtacttgtatcttcgctctaacaagctgtgtgatggtggtcctaacacctatggtgtaaagatttcccagattaggaaagtggtgggggttagcacctccggtggcgtcaccagtattcggctggataaagcgctgcactataactactacctgtctgatgccgcggaagtaggtatcccgacaatggtggagaacgtaaccttagtatccccgtacatcaacgagttcggctacgacgacttgaaccggttctttactagcggtatctccgccaacttcgctgcggacttgcacatccaggacggggttattattggcaacaaacgcccgggggcttctgatatagaagggcgtagtgctatcaagttcaataactgcgtagacagcaccgttaagggcacgtgcttctacaacatcggatggtacggggtagaggtgctcggctgctcagaggacacggaagtacacgatatccacgccatggacgtacgccacgcaatctctctgaactggcagagcactgcagacggggacaaatggggagagcctatcgagttcttaggcgttaactgcgaagcctacagcacaacccaggctgggtttgatactcacgacattgggaagcgtgtgaagttcgttcgctgcgtttcgtacgacagtgctgacgatgggttccaagcgcgcactaacggggtggagtacttgaactgtcgagcttaccgcgcagctatggacgggttcgcttccaacaccggtgtagccttccctatctatagggagtgcctagcttatgacaacgtacgctctggctttaactgctcgtacggcggtggctacgtttatgactgtgaggctcacggtagccagaatggtgtgcgaatcaacgggggccgtgttaagggtggtcggtacacccgcaactccagctctcacatcttcgtcactaaggacgtagctgagacagcgcagacatccctggagattgatggcgtgagcatgcgctacgacggtaccgggagagctgtgtacttccacgggactgtgggcattgaccctaccctggtatctatgtccaataacgacatgaccggtcacggcttgttctgggcattgctgagcggctacaccgttcaacctacgcctccgcgcatgtccaggaacttactggatgacacaggtatccgtggagtggcaacgctggttgctggtgaggctacagtcaacgcccgtgtacgcggaaactttggcagcgtagctaactccttcaagtgggtgtctgaggttaagttgacgcggttgacctttccttctagtgcaggggccttgacggttactagcgtagcacagaaccaggatgtgcctacaccaaatccggacctaaacagcttcgtgattaggagtagtaacgcagcggatgtatcccaggtggcctgggaggtatatctc

SEQ ID NO: 2 - protein, 651 aa, Artificial sequence
  specific to K1
MALIRLVAPERVFSDLASMVAYPNFQVQDKITLLGSAGGDFTFTTTASVVDNGTVFAVPGGYLLRKFVGPAYSSWFSNWTGIVTFMSAPNRHLVVDTVLQATSVLNIKSNSTLEFTDTGRILPDAAVARQVLNITGSAPSVFVPLAADAAAGSKVITVAAGALSAVKGTYLYLRSNKLCDGGPNTYGVKISQIRKVVGVSTSGGVTSIRLDKALHYNYYLSDAAEVGIPTMVENVTLVSPYINEFGYDDLNRFFTSGISANFAADLHIQDGVIIGNKRPGASDIEGRSAIKFNNCVDSTVKGTCFYNIGWYGVEVLGCSEDTEVHDIHAMDVRHAISLNWQSTADGDKWGEPIEFLGVNCEAYSTTQAGFDTHDIGKRVKFVRCVSYDSADDGFQARTNGVEYLNCRAYRAAMDGFASNTGVAFPIYRECLAYDNVRSGFNCSYGGGYVYDCEAHGSQNGVRINGGRVKGGRYTRNSSSHIFVTKDVAETAQTSLEIDGVSMRYDGTGRAVYFHGTVGIDPTLVSMSNNDMTGHGLFWALLSGYTVQPTPPRMSRNLLDDTGIRGVATLVAGEATVNARVRGNFGSVANSFKWVSEVKLTRLTFPSSAGALTVTSVAQNQDVPTPNPDLNSFVIRSSNAADVSQVAWEVYL

SEQ ID NO: 3 - DNA, 1731 bp, Artificial sequence
  specific to K2/K13
atggcactagtagatttagtgagggctgggggatattctgttgagtacccgcaattctccagtatggctaagctaaaagcattcccgcactctgaggacgggcaacttgttaggttgttgtcttggcatgagggggttggtttaggtggtgggctgttcaaggtcagcaccagcagcaccgctacaggtaacgatggtacggtagtagtggctagtaatggagtgcggctgcttcgagtagtaaacggacctatctgggcagatatgtttggtgcactaccaaattcagatatagacagtatgccagcagtggctgcggcttatgcgtacgctgcttctgtgaatacggacctgtatatcggggtggcgacttacaaattcaagggaagcactccaattaatgtagacccatccagggccggtattattggctatcaaggtaaagtgcgcattgactgttctgagtttactggttcgattgtgttttctataaatagcagctatagctatacccccgcagcctactacaacaaccttagcccagccctgcaggggctgtacgtgtttggtgctaaaacgtccggagtagacgggctactggttggcagggaaacagtgggatcggacaagagctataacgggcagaccgaggttcgtgagtgcacgttcgataagtttgaccgcaacatccgaatggggcacaactcttggcgctttgtgttctacaaagtaaacagcctaaacgctctcagccctaacgggatattgtatgtaccggccggactagatgactctggggagattctgtcgttctaccactgccagttcttcgatggtgcaggtagtaatatccgattatcttgctcctcatacactatggtatttaatacctgctcgttcctgaacatcacgttctttgtggattcggcgagtagtgcgacagtaacctgtaacggatgcaacttcgagaaccctggaagtgctagtacccgtagatacgttgacattagtgctgggcacactaacgtattcaacattatcgggggcagtatagttacaaacagcaaccctggacagactcaggcgcttctgtatgtctctaccgacaacctactgaaccttgtaggtgtaactgctccttacggcgggcactaccagcaggagcaggagctcgggtatcacgcattcatcggaggggccggtacagtcacaacctctggggttatgctgcagctacgcaacggggcgggtacgtgtcctttgcactccagtcttagcacgttcagtaactggaattttggttatgggaacctgaatgcttggacggtagataaggggactggtacatcctctgtggtagagtatctggctaatgctggacctaaaggtacagagggagctatgcgagttgctcctgtaagtgtcggtaccaacgtatcacaagtacaggcagtaactaaccccggcatgttcagtatgtcctgcatggtgaacattgcgacgacccccggtaacgcggggcaggtatctattgggttcttggatgctgccggtaacagtctacctggtggggtatcagctaacctgggtaccaccacaggttggcaggtaatcggcaagaacaccttgcggggcaaagttccaatcggcgcaaagcaggttcgtgtgaacattcagactgtggctggcgcagacgttaagtacgcgtacttgctgtgcaatgtggtcaag

SEQ ID NO: 4 - protein, 577 aa, Artificial sequence
  specific to K2/K13
MALVDLVRAGGYSVEYPQFSSMAKLKAFPHSEDGQLVRLLSWHEGVGLGGGLFKVSTSSTATGNDGTVVVASNGVRLLRVVNGPIWADMFGALPNSDIDSMPAVAAAYAYAASVNTDLYIGVATYKFKGSTPINVDPSRAGIIGYQGKVRIDCSEFTGSIVFSINSSYSYTPAAYYNNLSPALQGLYVFGAKTSGVDGLLVGRETVGSDKSYNGQTEVRECTFDKFDRNIRMGHNSWRFVFYKVNSLNALSPNGILYVPAGLDDSGEILSFYHCQFFDGAGSNIRLSCSSYTMVFNTCSFLNITFFVDSASSATVTCNGCNFENPGSASTRRYVDISAGHTNVFNIIGGSIVTNSNPGQTQALLYVSTDNLLNLVGVTAPYGGHYQQEQELGYHAFIGGAGTVTTSGVMLQLRNGAGTCPLHSSLSTFSNWNFGYGNLNAWTVDKGTGTSSVVEYLANAGPKGTEGAMRVAPVSVGTNVSQVQAVTNPGMFSMSCMVNIATTPGNAGQVSIGFLDAAGNSLPGGVSANLGTTTGWQVIGKNTLRGKVPIGAKQVRVNIQTVAGADVKYAYLLCNVVK

SEQ ID NO: 5 - DNA, 2196 bp, Artificial sequence
  specific to K3
atggctactaccccaactaataagccaatcccctctgaagacccgcgcgatctgaagtttaacgccgggaagattgatgaagaggttaacggaagcgctgattactacaccgaccgattcggcgtgcagagactgacgaacacaggcaggaataagcaatttcaggatgcgcagactcagagagaatctgattttgtcgcatcacagactgataaagaagcacgttttcagcaattcctcttaaactctggttatcagtttttaggagattatgaaaatggaccgtatacaataaatgagcttaatcaggtaattcgttatcagaatgagttctggcgtttaaattcagccactaccccaccttatacaaccacaggtgttaatagtacatcgtgggccaccgatgttacgcatctggtgagtgttggtgatgctaatttaaggcaggaattatctttctcttctggactaaaattaattggacaatgcgcaagcatagccgcgttgcgcactattacatttgaatctgtcggacagcaagtgtttgttaaagagcatacctctggaatggggcagggcggtggtatattttattgtcattctttgacaaacccgggctcacttgttgatgataacgggttccaaatagttacggcatctgggcaagtcttacgtagaaaagaccgcaacataatgtctgccgagatgtttggtgctatcggcggacaggatataactcccgtattgaataatatgttgctggcgtctaaaacgtttaacatacaagaggcccatatcccgcaccctcttaataaaacagattataccgcctcaggtggtagcgttgccgatgtcactgatgggatagggtttaatttaataggcctgaagatggtaaataaagggccagcgataaaccatatctcgaataatatctttttcagattcaggaagaatggacccggatcgtctagtttttatgagcaatgtagtgctacggggcttctcatccgtgggcgtaatgcggcaaatacagcagcaggtaacgacggttatgctattgaggcatcggacataatagggttttattgtgatctgttctgtactgggtatacaaatactgcggcggctgcggtgtcgatatacaatgatacgagttttacggagcaatctcgcattaagttacatattcgaaactgctgtaatggtatccatttccaccgtaatgcttcgactggagcgacaagtacaaactcattcatgggtacagaacttgacttgtctttccaagctgccgtttctggtaaaactaacaatggtattgttgtaggaaatttagatggtactgctacgtcaaacacatttgatgttaatttgtatgcttctaaaattaaaatgaaatattgggcagaaggaggttctgcgacacgggctattctagttacagctaaaggtatagtgccagaatcaacaacatttgacctgatatcagatggctacggatttgtcacgtcagatacggatacaactacagatccggctacacagttaatccgtgttgaaaatggcggtgtattccgtgctaaatgcatcgatcagtcaatgcaaacagggttgagtcaccgacttaaccaactacagcgtctcagtaacagcattttttcattccaggacgatacgtacaaagtgccatataccgatgcacgtccttacatcaaccctatggggatgtcttgtatttgctctggcactattgatgtggctacgcagcaatcaggggcgtcatggcagatatctggcctgcctatggggatgcggatcagggttacgataaatcaatacctggagggagaatccgccactagcgttcaagaggtgtgggaagttttggtgcgaggggacgcgcagtcagtaatttgcaccccgttggttacaaatgacgtattaactacgaccactggcctggcggtggttaactcatcattcgcgacagcaacattccttaaatcagtggtagcagcttttggcaagttttggcagggagactcaaccagaacgcgcctgactgttagaaataacaatgatgataactcattaacaacagggtcatcagacggccgcaagtttaggatatttcttccagtgaatgcctccgccaccagcattctacattattcagttaaattggaggtgata

SEQ ID NO: 6 - protein, 732 aa, Artificial sequence
  specific to K3
MATTPTNKPIPSEDPRDLKFNAGKIDEEVNGSADYYTDRFGVQRLTNTGRNKQFQDAQTQRESDFVASQTDKEARFQQFLLNSGYQFLGDYENGPYTINELNQVIRYQNEFWRLNSATTPPYTTTGVNSTSWATDVTHLVSVGDANLRQELSFSSGLKLIGQCASIAALRTITFESVGQQVFVKEHTSGMGQGGGIFYCHSLTNPGSLVDDNGFQIVTASGQVLRRKDRNIMSAEMFGAIGGQDITPVLNNMLLASKTFNIQEAHIPHPLNKTDYTASGGSVADVTDGIGFNLIGLKMVNKGPAINHISNNIFFRFRKNGPGSSSFYEQCSATGLLIRGRNAANTAAGNDGYAIEASDIIGFYCDLFCTGYTNTAAAAVSIYNDTSFTEQSRIKLHIRNCCNGIHFHRNASTGATSTNSFMGTELDLSFQAAVSGKTNNGIVVGNLDGTATSNTFDVNLYASKIKMKYWAEGGSATRAILVTAKGIVPESTTFDLISDGYGFVTSDTDTTTDPATQLIRVENGGVFRAKCIDQSMQTGLSHRLNQLQRLSNSIFSFQDDTYKVPYTDARPYINPMGMSCICSGTIDVATQQSGASWQISGLPMGMRIRVTINQYLEGESATSVQEVWEVLVRGDAQSVICTPLVTNDVLTTTTGLAVVNSSFATATFLKSVVAAFGKFWQGDSTRTRLTVRNNNDDNSLTTGSSDGRKFRIFLPVNASATSILHYSVKLEVI

SEQ ID NO: 7 - DNA, 2052 bp, Artificial sequence
  specific to K5
atgttagacaaactgaatcagccgaaaggctcaaccattggtgtgctcaaggatgggcgcactattcaggaggcattcgactccctaggctaccttggggtggccgttctttcacccgccaattacggtgccaaaggtgatggtaaagcggacgatacgattccactgcggcaatgcgttcaggatgcgtgcgccttgggtggccgcgttgtcggtactgttggtgctgagtacaaaatctcagggaccattgcgggaaccgtaggagacggtaagtacgttgagctggacttcacaggttctaagtttgtgcccaccactgatgacgctgtcatgactataactggtgttgcgacctccccagtagctgaggtaaccgtcgaggttgtctcggtgaacttaggtaatggctccaccaacacgattgcgatgaaggtaacagctcctggcggacactcattcaccaagaagggtgagattggcaaggcatggtctccggtgctgtgcctgaacaacgacctgtccactcagtatgcaggtgagccgttcgtcgtgggactcgtggaatcgtctacagtgttctacaccaccagcgtattcaccgagttgtacatggggaccagcctcaaggtaatccgagtgccgaccactcaggttgtcgtgaagggtctcgatgttgagtccgagtggactaccggatggaaggccagtacgttgaccttaagcggactgctgcgaccgttcgtgtacaagcctaagtgtaagaacatcaacggaccgttcgtgaacctgactggttgctacggtgccactgtgttcctacctgaaggtgacaacctgcgaaatgctccgtctgaaggtgcctacgggtacttcgtgaatgactcggcgagcttcggttccaccatctacggcattaactgtacgaacgcccgtcatgcgtacacaacgtcttcacctcgtagtgagcctacggatgacaagtggtggttgaagggacgcaccttgttctcagagattaccaacggtctgggcacagggtgccataacgccttcgacacgcactcaccttcttacggaatcaagttcactaactgccgagcagtgggtgacttccgtggtgtggacactggaggggctggcttccagattcgaggagaccgtagctcactggttgactgtacggcgattaacagcaagattggcgctgcgttcacagctgtgaacatctctggtaactctgagttgtacatctcagggttcacctatgagggtccagcaggacacttagcgttatccctgtcaggcaaagctggtcaaatcaaccgtgtaaccatctcggacagccgctggaaaactctggaacagtacgcgaccgctatcaccaacgttgaggtatccgcaagtaacgttgaggctgttgtggactcagcgaccactgcgtctgctgcgtggcgtatcggtgaaggagcaaccctacgtacccgtggaggtgcagctcggttctctgctggctcagggcactccgtgattagtctggcagcgtctggagcaaaggttgatgttggcgacctcgaagtcaccgggtcttccttcatgcagtacctgctggcgaccttgtctcagtacgctggtgatgtgtacatcgaggcagaccttgatggtgcccttccgggtaaccctgtgggtggtggtggtactgaccttaaggcggctgtagtgtacactgctggtaataagttccgtcgacctctggcctaccgtgcgttgactattggtaacgccaacggtaacactctgggactgaactactcaggtcacgatgttatcacttgggaaatcacagcgaccgtcgcgggagctaacgtcaacgggattactccgggtgcattcattgggcagcagctgaacattggtagctccccagcaagcactcagcagctaatcatcaaaaacggcaccaacattgcgatgggacacgcagtcacccttgaggctggccgtggtgttaccttgtactggaacggagctaactggcggagcggttccgtc

SEQ ID NO: 8 - protein, 684 aa, Artificial sequence
  specific to K5
MLDKLNQPKGSTIGVLKDGRTIQEAFDSLGYLGVAVLSPANYGAKGDGKADDTIPLRQCVQDACALGGRVVGTVGAEYKISGTIAGTVGDGKYVELDFTGSKFVPTTDDAVMTITGVATSPVAEVTVEVVSVNLGNGSTNTIAMKVTAPGGHSFTKKGEIGKAWSPVLCLNNDLSTQYAGEPFVVGLVESSTVFYTTSVFTELYMGTSLKVIRVPTTQVVVKGLDVESEWTTGWKASTLTLSGLLRPFVYKPKCKNINGPFVNLTGCYGATVFLPEGDNLRNAPSEGAYGYFVNDSASFGSTIYGINCTNARHAYTTSSPRSEPTDDKWWLKGRTLFSEITNGLGTGCHNAFDTHSPSYGIKFTNCRAVGDFRGVDTGGAGFQIRGDRSSLVDCTAINSKIGAAFTAVNISGNSELYISGFTYEGPAGHLALSLSGKAGQINRVTISDSRWKTLEQYATAITNVEVSASNVEAVVDSATTASAAWRIGEGATLRTRGGAARFSAGSGHSVISLAASGAKVDVGDLEVTGSSFMQYLLATLSQYAGDVYIEADLDGALPGNPVGGGGTDLKAAVVYTAGNKFRRPLAYRALTIGNANGNTLGLNYSGHDVITWEITATVAGANVNGITPGAFIGQQLNIGSSPASTQQLIIKNGTNIAMGHAVTLEAGRGVTLYWNGANWRSGSV

SEQ ID NO: 9 - DNA, 3540 bp, Artificial sequence
  specific to K7
atggctaataaacccacgaaaccaaattttccgcttgggcttgaatcacaagaacaatccgtattccaagaaggtattctgaataatggtgttgtagaacatggcccagatgcggtaatgactgtgccagaaactcctgatgcttccggagttccttctgctgtccgttacaacgaagacgacgaccaattcgaaggttattacaacgaaggtggttggttgccgcttggtggcggtaacggtggtcgttgggaagcgcttccgtatgcttcctcttccttattgcaagctgggcgtgcatatctggtggataacacagacggcgtctctacggtgctgttcccttcccctaaacgtattggcgacagtgttactgtctgtgatctttatggtaaattctcaacttatcctctgactgttgacggtaacggtaaatcgatctatggatctgcggatagcatgacgatttctaccgataatgtcagtgcgactttcacctggacaggtgaggcccgtggctgggttatcacatcgggtgtcggtctgggacaaggtcgagtttacagccgcgaaatctatagccaagtcctgtctgctgaaacatcttctatcactctcagcactcagccgacgattgtagatgtttatgccgatgggaaacgcctgaaagaatccctgtatactcttgacggttatgaagtcaaattcgatccggcgttggcctccggttctgatgtacagattattcagtatatcccaattcagcttggcgcgggcggcgggggttctggtggtactgtaatcacctgggaatacaacggcggcgcggcagtcggcggtgagacgcagatcgtattggatgtggttgtagactcagtatctgagatctatatccgggggcagcgtcaacagatcggtcgcgggttcacctttgacgcagagactagcacaatcacgctcgctgatgaattggaaactggcgatgatgtcgtcgttattattaatggcgacccaacggtctacaaccagattgatcgtactccttgggaagtcgctcgtgcaaataacgtgagcaatgatgaagtcatactcagtaccgacaagcaaaccgtattggatggtaaaaccgttctctatgacgtggcaactcagactagctggggtattcctgaaggattgccagctggtgttaagatttcaaccgtcaatgctggggttttagtttatacgccagggaacgttagtgttgaaatagagaaaataccatccacaatggatattaactctaaaactggttgggataaaatcgggactgtttccagctttgatcagttgaaaactatcattccaaccaaggcaggacaattcattaatctacgttcctacaatgatggttggagtgctatgaattctgccccagttggtggtggtatattcatttctaagtccgggggtgctgtggatgacgggggttatatttgcgttccaactggccaaacggaatattattgggaacgtgttctggagcatgatgagtaccttacgccgcaaatgtatgggtatatccctgattataacactacaacatataccggtactgatgtaaaaccatatattcaggcagctattgacacttctatatctataaacaaaggtaaagtccatttaccagaagccaactattatacggctatcggtaatatagagcttgcaggtacagggcacaacagggcgttgggtgtcagggtatatggtgtacgcggttcacaccgggctgggggttcacgtgtgttttttaacgctccagcgatagacaccccgttatttttgtccgtttctccatcttcactatacaccatgcatggtatagatgatttatggctggaggctgtacaatctaatttatattccggctatgcccttaaactggtcggttcttgccatatggtttgtgatcgaattcacgttgagcgcatgagggatgggttgcacctgcttaatactcgaactctgactacagataacaacgatggagaccaaaacggattttgtgaatttaacgctttccgagactggaatctaaataaatgctacaacaacgtttcttttaacaacgatggtactggcgacccaagcctaaatggcaacgtattcattaacatgaagagccaattgaaagaagatggtaatggtatctatttcaatggtacgaacggcggtctgctttggtataactcccctgaaaacagcattaaattctggggcggcgcagctactggagttaatacttgccaacttctgagggttgagggaaccgaagttcgtggtgttggcggcggaatgacatgggaaggttttggtcgaatatcttgtgatgctaacagctatttccgttttgatgggaatatatttgggttgccgggcaataaagcactaattgattattctggcgtcgtcggagaaaacaacctgtgtgacgctagggttattttcaataatacgacctcccgcgaccggattaatatgtctaatgccattatgtcgccttattttttcaggccgataatgtcaattagccgatctgcaaaaaataatacgaactatgcggtggccatgccaattcgcataaccacatctgctacagaaaaaccgacaacaaatacggagtacgaagggttagcattccctaccaaccataatggcgacgtttggtttggtgaagttgtcagtcagtctaactggttcggtatgataccgacgttaaaatacggtagctcatcgggtagttttaccagttataccgcaggtattacctggaatattaagaactcatccggcgcggatgcggggtctaatgctggttgggtgatgggtactaacttttatcctctgaccacgctagcggccagtttagggttgaccacaaaccgactcaatgctatttacgcaaacggtggacagataacaacatccgggatattcccaaggacgacagcagcttatgatctcggctcaccaactgcagcatggaacaacttacatattcagaactcacccaacgtaatatctgattccaatttaaaaccggttcaggaagatttgagtgatgctgagattgaagtggctaaaatatgttctaaattgtttatcaaatataagctggccgcggcaattgctgaaaaaggtgattctgcccgatatcattttggtgtggttgcacaaaaagttatggcggctttctctgataatggattgtcggttgactcatatggtgtacttgtaacttctaccattaaacaggtagtcgttaaaagtggagaaaattatgagccaatccctgacgagaatggagagatccacattccagctaacgatgacggattcattgagttgattgatggtatggacgatctgtcaactgatgaatttggtgttgttgtccttacgaggacaactcaccttatcaggtatgaagagttgttatgcttcataaatgcgggtatggttgctaggttagaagccttggaagcccgattttct

SEQ ID NO: 10 - protein, 1180 aa, Artificial sequence
  specific to K7
MANKPTKPNFPLGLESQEQSVFQEGILNNGVVEHGPDAVMTVPETPDASGVPSAVRYNEDDDQFEGYYNEGGWLPLGGGNGGRWEALPYASSSLLQAGRAYLVDNTDGVSTVLFPSPKRIGDSVTVCDLYGKFSTYPLTVDGNGKSIYGSADSMTISTDNVSATFTWTGEARGWVITSGVGLGQGRVYSREIYSQVLSAETSSITLSTQPTIVDVYADGKRLKESLYTLDGYEVKFDPALASGSDVQIIQYIPIQLGAGGGGSGGTVITWEYNGGAAVGGETQIVLDVVVDSVSEIYIRGQRQQIGRGFTFDAETSTITLADELETGDDVVVIINGDPTVYNQIDRTPWEVARANNVSNDEVILSTDKQTVLDGKTVLYDVATQTSWGIPEGLPAGVKISTVNAGVLVYTPGNVSVEIEKIPSTMDINSKTGWDKIGTVSSFDQLKTIIPTKAGQFINLRSYNDGWSAMNSAPVGGGIFISKSGGAVDDGGYICVPTGQTEYYWERVLEHDEYLTPQMYGYIPDYNTTTYTGTDVKPYIQAAIDTSISINKGKVHLPEANYYTAIGNIELAGTGHNRALGVRVYGVRGSHRAGGSRVFFNAPAIDTPLFLSVSPSSLYTMHGIDDLWLEAVQSNLYSGYALKLVGSCHMVCDRIHVERMRDGLHLLNTRTLTTDNNDGDQNGFCEFNAFRDWNLNKCYNNVSFNNDGTGDPSLNGNVFINMKSQLKEDGNGIYFNGTNGGLLWYNSPENSIKFWGGAATGVNTCQLLRVEGTEVRGVGGGMTWEGFGRISCDANSYFRFDGNIFGLPGNKALIDYSGVVGENNLCDARVIFNNTTSRDRINMSNAIMSPYFFRPIMSISRSAKNNTNYAVAMPIRITTSATEKPTTNTEYEGLAFPTNHNGDVWFGEVVSQSNWFGMIPTLKYGSSSGSFTSYTAGITWNIKNSSGADAGSNAGWVMGTNFYPLTTLAASLGLTTNRLNAIYANGGQITTSGIFPRTTAAYDLGSPTAAWNNLHIQNSPNVISDSNLKPVQEDLSDAEIEVAKICSKLFIKYKLAAAIAEKGDSARYHFGVVAQKVMAAFSDNGLSVDSYGVLVTSTIKQVVVKSGENYEPIPDENGEIHIPANDDGFIELIDGMDDLSTDEFGVVVLTRTTHLIRYEELLCFINAGMVARLEALEARFS

SEQ ID NO: 11 - DNA, 2247 bp, Artificial sequence
  specific to K8
atggaccaagacattaaaacagtcattcagtacccagtaggggccactgagttcgacatcccgttcgactacctgtcccgtaagtttgtacgtgtgtcgcttgtagctgacgacaaccgcagactgctgagtaacatcactgagtaccgctacgtgtccaagaccagagtgaagctccttgtggaaactactgggttcgaccgtgtggaaatccgcaggttcacctcagcgtctgagcgaatcgttgacttcagtgatggctcggttctccgcgctgctgaccttaacgtatctcagatacagtcagctcacattgccgaagaagcaagggacgctgcactaatggccatgccagaggatgacgcaggtaacttagatgctcgcaacaggaagattgtcagactggctccgggagaggctggaacagacgccataaacaagaaccagttagatgaaactcttggagaagctggtggcatcttgtcagactttgaggatgtgcgtgatgagattattcagtacatctccaagttcacggatgacaccggggctgtacgcggagtatcttacgtgtacaacaacgggagagcacttggcggtgagactggttttcacatcgatattacaccacctccgctgggtgttccgtacttgtcgataaacggtagcaagcaatatcggggatatcacttcacgtatgacccgattactggtaacgtgcaaggactggcgacgccactggaaaaagatgacttcgtggttgccactaccacagagagcgtaacaccaatagaggatttatacgccagcacacaaggtgcatccatgataggaacattgagtggtagcactgtggaggagcgcatagccgaagtagaacagagcgttcttgactcaatagacggaatccgagttgatagcttcatcgggatgactgatagcggtgcgatagatgcagccatcgcagaggccctccgagtaaatagctacgtcaagttttctccacgtgtgtacacggttgacagacctgtcattctcccctctaagacagtgctggtaggaacccaaggccttactaagatagttgccagcgcgagctggaatggcccagtggtgatgtcaaaggatgcacctgctggggactacctgactataaacgtaccgtctgcaatggtgtacggggtgtatatcttcggaatcatcattgagtcgggctggaagggtacaacagacgactcccggtaccacaccgagtgtttacgcatttacggcgcaggaacaatactgaaaggtgttcgtgttggtaagtgtcgtggtgatggggctaatcttggcggtcgaggactaaccgctattgattatggggctcctagtctctattcggatgtacgtgctgacctaattggtaagaatggtataaccattggtggttcctcggacaaccacactcagaacatcgttgtgcgaaacgcaggattattggagcatgacgtttactactgcatcggcatcggtccgggaggtggtacacgcggtaatgaataccacacgtggcacagtggtgacgcccagataaccccgctgtatcaaaacaggcctaaatacggactgtatctggctggttgggacacctatatcaccaacggccacttcgagggtgcggcaagtgctcagatagcaaactttggtggtagaaatcaggtgaccaacgttcgggcctactctacttgggaccaagataagtgcacagttctagttgcaggacctgccttcaagttcgttggtaacattggtgcccctatgaacaatgtaccagctaaccgctgccatgcgttccaactgggtacagcggacatacaggttaaccaagtggaaatcacggctcaggtaaacggccagaagtttgtcaactacgtcaatgctggcggttctaactccattgcagtgcgcggtactctcggtattgctggagcctccggcataggaacattggtcactgggactgttcctgatgataatgaactcacaatcattgctgagccatataaaggtaagcggttaggcttgaacctgatactgacgggagacaagggcctgacgtgtcgtgacgttaactctacaggacagattagcggagtcaatgcgctacttactggtaaagttatgttaactggcctcagttctgatataccaaccactccgggcaccgtgtacgtcgattccaacggtaacctgaaagtaaaacta

SEQ ID NO: 12 - protein, 749 aa, Artificial sequence
  specific to K8
MDQDIKTVIQYPVGATEFDIPFDYLSRKFVRVSLVADDNRRLLSNITEYRYVSKTRVKLLVETTGFDRVEIRRFTSASERIVDFSDGSVLRAADLNVSQIQSAHIAEEARDAALMAMPEDDAGNLDARNRKIVRLAPGEAGTDAINKNQLDETLGEAGGILSDFEDVRDEIIQYISKFTDDTGAVRGVSYVYNNGRALGGETGFHIDITPPPLGVPYLSINGSKQYRGYHFTYDPITGNVQGLATPLEKDDFVVATTTESVTPIEDLYASTQGASMIGTLSGSTVEERIAEVEQSVLDSIDGIRVDSFIGMTDSGAIDAAIAEALRVNSYVKFSPRVYTVDRPVILPSKTVLVGTQGLTKIVASASWNGPVVMSKDAPAGDYLTINVPSAMVYGVYIFGIIIESGWKGTTDDSRYHTECLRIYGAGTILKGVRVGKCRGDGANLGGRGLTAIDYGAPSLYSDVRADLIGKNGITIGGSSDNHTQNIVVRNAGLLEHDVYYCIGIGPGGGTRGNEYHTWHSGDAQITPLYQNRPKYGLYLAGWDTYITNGHFEGAASAQIANFGGRNQVTNVRAYSTWDQDKCTVLVAGPAFKFVGNIGAPMNNVPANRCHAFQLGTADIQVNQVEITAQVNGQKFVNYVNAGGSNSIAVRGTLGIAGASGIGTLVTGTVPDDNELTIIAEPYKGKRLGLNLILTGDKGLTCRDVNSTGQISGVNALLTGKVMLTGLSSDIPTTPGTVYVDSNGNLKVKL

SEQ ID NO: 13 - DNA, 1692 bp, Artificial sequence
  specific to K9
atggctaactgcagtgattatatcagtgctgacgaccttaaaacaggtaaacaagcagtccaacacatagagcacgttgctaaaagcaaagatgctaacggtgcgcatgctttaactgtaactgatactattcgtggtgagcaagtaacgaacttgacacttgacggcatggaaacgcagtttcagacagcacaagatgagcgtgaaactgaatttgaggcatcacaagctgataaagaagcacgctttcagcaattcctcttaaactctggttatcagtttttaggggattatgaaaatgggccatacacaattaccgcttgcaaccagattattcgttatcagaatgagttctggcgcttaaacgcggctactaacccaccatacactactactggtattaacggcacatcttggggtgtcgatgtcacacatctggtaagtgttggtgatgccaatcttcgtcaggaattgagttcaagcgaaggcacttcattgatcggggcgttaggcgttaggccattggttgcggttagtcattataaaaataatggcttatcggatcaagatgctgtgcaggccgcatttaacgaatcaagtaacgtccttatagatatcgatgttactttaactgattatgtaacaatggaccgatcccgggagtgttatatagttcgtacccccggcgttgttattacaggtcatggttacttacctaagttaagaactaaccctgctcatgtagttgaaacagcaatacgccataataaaacatcagacccaaatgcaacatcatatgaccgcgtttattcgcatcaaacgtttgctgcggaaatggctgttactgatgttttgtctaccgcgtcatcttctgaaaactttgtcgcattgtattcaggcattgagacatttaattgcggcaagcagagaatatgggcttttaactccgtaactaatgcacataaccttttaactggtgatgaagtatacggttatgaattagacatgaatgtcgatggcacactcgatggtggcggacaatatgtcggattatacattgctggcattggcgacctcagaacatgtgctaatgctgatggtatccgtgttcaacggttaagagatggtgcgtataaatggcagtatgggttaagaatctttgattctatgactggagttaatatcactgacgcttctacatattccgtctttgcgtcgggtagcgctccagtagtgcgcaggaagacaacacaagatggcggatggtcatattatcactctgtgtctgtatcaaatatcccctggggtgttgatgattatggggacacctactctcgcagattgtacctcggcacagggaacggtaaatctaaaaatagggtaaaccttgatggcggtgtgaaattctatactaccaacgtagctgtgtcgtggggggcgatagctgcaaatgcttatgtagacaaggatgttactgaactttttgggatttccatcgctgactggactaactacacattagatgtaacgccagtcggatatgctgggtcaatgcctgttgtggctgttcaggcttatatcaacagcgcaaaaactcaggcttacgtgcgtataattaatatcagcggctcatctttgtcatcatgcaacgttgggttgaacgcaaagttgtgtggccattcagcaacaaac

SEQ ID NO: 14 - protein, 564 aa, Artificial sequence
  specific to K9
MANCSDYISADDLKTGKQAVQHIEHVAKSKDANGAHALTVTDTIRGEQVTNLTLDGMETQFQTAQDERETEFEASQADKEARFQQFLLNSGYQFLGDYENGPYTITACNQIIRYQNEFWRLNAATNPPYTTTGINGTSWGVDVTHLVSVGDANLRQELSSSEGTSLIGALGVRPLVAVSHYKNNGLSDQDAVQAAFNESSNVLIDIDVTLTDYVTMDRSRECYIVRTPGVVITGHGYLPKLRTNPAHVVETAIRHNKTSDPNATSYDRVYSHQTFAAEMAVTDVLSTASSSENFVALYSGIETFNCGKQRIWAFNSVTNAHNLLTGDEVYGYELDMNVDGTLDGGGQYVGLYIAGIGDLRTCANADGIRVQRLRDGAYKWQYGLRIFDSMTGVNITDASTYSVFASGSAPVVRRKTTQDGGWSYYHSVSVSNIPWGVDDYGDTYSRRLYLGTGNGKSKNRVNLDGGVKFYTTNVAVSWGAIAANAYVDKDVTELFGISIADWTNYTLDVTPVGYAGSMPVVAVQAYINSAKTQAYVRIINISGSSLSSCNVGLNAKLCGHSATN

SEQ ID NO: 15 - DNA, 1974 bp, Artificial sequence
  specific to K10
atgaccacaccaacccagttaccgattcccagcaataacttgctggattcgagatttaactttgagaaattagatcagatagttaattctgatgctaattattacgtagaccgattcggtaaacaaagattaactaccgccggacttcagaatctgattaatcagataggaagtgattttcaaaataacgttggactccctgacgggtctaaatttatagggacttgtatcgacgtcactacattgagatccgtggagccctcggtagattatcagcgaattattcttaaatcttatcactctggatggggggcttcgtcgactcccccggttggagggggagagctttattacgatcccctggacaaaacctcagacgatgacgggtttctaattttcgttactcccaagggggcgagatggaagaggaacttaaaaagggaatatacctttgaacaagcgggttgttttgggaataaaattaatgatgattccgattctcttcaaaaggctttaaatcttcaattgatgggttacaccatcacttctgaaaattctaacgcgagatatttgttttctaagcagctcgtcgtttacgccggggaaggcgagttaaacatgggattgtccagacttattgtcgatccaaccaagttaaactcaggtttcgcagtcagagttatgggtgatattaataaaacttacaacgctggcagtaaaataaaattaaatttgcagggtccgtacggcggggatgagtggagctctcccccattgatagtttctggaactcttgatggggtcgggatttatccagggaactccactcaggtatcgggggtcgtctttaatgatctttggatagaaggatttagagactgtttatatattggagataagtcggtttatcttttgcaatttaacaatgcacatcttgggaagttctggcgctatggcgtgcacttcaactgtttaaatgacgccggagaaaatatatcttttaatggcggcgtcatctttaacgggaaaaattccgataactccacttcggcagtgtattcgaccccagacggtcatttcattgacgccttcttctataaaacatcttttgattacacagatactgttttcaaattaaactcagggtccttaagtttcttaggctgtcattttgaaaataattctctaatgccctacggcgttattacttataccagtggtaaaagaaaaccacaagtcgatcttttctccgtcaatatcgacggaggtaatgatgtcgctcaggtaggtgctaataccggcaaaccggctttcttccttaccaatggtttttgtcgattgagcgcggacggggggagttggggaaaatacggtaaaatgcagtcatccatgatagtgaactctgtcagtggccgaccccaggtttccattaagaacattttcttcgacatccaaggtggagtagattatctcgatttaggaaatactgtttccccaatgagaaactataatttttctacgggcgatcttaccggatggactgtcgattattcagtatcctctggtgagccagtaaaaccaactgtgacgtttgccaacaatccgacattgggaaattctgtcaaaatcacgggtacatctactggaggcggaacaacaacattagtggggcaggacattcaggtccatccaggaaggatattatatctttcaactaagttgctctggaataacttagttgcgacatctggtaacggttatttcggcgtcacttggtatgacataagaggtaacgagattagccacgttaacgttggggttaacctgaatactcaatccagcacagttacgaacgcagttatttgcagtggctttatctccgttccaaatggcgcggttaaagctaatgtaggtttcaggcattatcaaatgaccggggacatttttatgggtccggtttgtgtttttgaacaa

SEQ ID NO: 16 - protein, 658 aa, Artificial sequence
  specific to K10
MTTPTQLPIPSNNLLDSRFNFEKLDQIVNSDANYYVDRFGKQRLTTAGLQNLINQIGSDFQNNVGLPDGSKFIGTCIDVTTLRSVEPSVDYQRIILKSYHSGWGASSTPPVGGGELYYDPLDKTSDDDGFLIFVTPKGARWKRNLKREYTFEQAGCFGNKINDDSDSLQKALNLQLMGYTITSENSNARYLFSKQLVVYAGEGELNMGLSRLIVDPTKLNSGFAVRVMGDINKTYNAGSKIKLNLQGPYGGDEWSSPPLIVSGTLDGVGIYPGNSTQVSGVVFNDLWIEGFRDCLYIGDKSVYLLQFNNAHLGKFWRYGVHFNCLNDAGENISFNGGVIFNGKNSDNSTSAVYSTPDGHFIDAFFYKTSFDYTDTVFKLNSGSLSFLGCHFENNSLMPYGVITYTSGKRKPQVDLFSVNIDGGNDVAQVGANTGKPAFFLTNGFCRLSADGGSWGKYGKMQSSMIVNSVSGRPQVSIKNIFFDIQGGVDYLDLGNTVSPMRNYNFSTGDLTGWTVDYSVSSGEPVKPTVTFANNPTLGNSVKITGTSTGGGTTTLVGQDIQVHPGRILYLSTKLLWNNLVATSGNGYFGVTWYDIRGNEISHVNVGVNLNTQSSTVTNAVICSGFISVPNGAVKANVGFRHYQMTGDIFMGPVCVFEQ

SEQ ID NO: 17 - DNA, 2625 bp, Artificial sequence
  specific to K11
atggaccaagacattaaaacagtcattcagtacccagtaggggccactgagttcgacatcccgttcgactacctgtcccgtaagtttgtccgtgtgtcgctggtagccgacgacaaccgcagactgctgagtaacatcactgagtaccgctacgtgtctaagaccagagtgaagctccttgtggaaactaccgggttcgaccgtgtggaaatccgcagattcacctcagcttcagagcgcgtggtcgactttagcgatggctcggtgcttcgtgcagcggaccttaacgtttctcagctccagtctgcccatatcgcagaggaagcccgtgactcggcactactggctatgccacaggatgacgctggcaaccttgatgcccgtaaccgcagaatcgttcggctggctccgggtgttgaaggtactgacgcaatcaacaagaaccagctggacactaccttaggtgaagctggtggtatcctgtcggaaatcaaacagaccgagaaggacattcaggattacatcgagaactttgcggatgacaccacgtctctcaagggaatcaactgggtgtacaacagtgggtcggccaacggtggtgagacctccattctgattacccgcgaggggccagttttcgctgtgcctaccatttacatcaacggggacagacaggctgttggttaccactactcttacgactccggtgataaaaccattcacctagtcaagcctctcaaggctggagactttgtggagtgcgttacctctgagggcgtactaccgctgtctaacctcctgtcgacaccagatggggccagccagattggcactaagagcggcctgactgtgcaggattacctgaacggcgtgaagtccgcaactattctgcgaaacattgagccagccattgacggacagcgaatcgtcctctctgagattagccctactctgggtcctaagtctgggggtaccttggtgtatgaccagtctgacacatcctctgtggacgacgggtacactgttttcgtaacagctggcggcaaacgatggaagcgcgaagagtcttacattgatgtagcgtggttcggtccgaactttggccttgccttacagaccgctgttaacctagttgacaactacgtgagaactgtcggtttctacagccgcaagaccatctacattgcagcgggtaactacaccactgacaggcagattgacataccgtcatatgtttccgtggttgcaattggcaacgtgaatatcaatggcgcatctcttccggttaactcctacgtaatccgaatcaccaacaaggtgactggcatctccacgacccagcactctggctggaacttaggttcggtgggcggtactctccgtctggtaggaaacggtagctccaaccaagttgacggactgtttgttggcaacaccacggccatgagcgatgtacgtaacgtcagcctctacgctgtggcaacctcaggcgtacgctacgggttaacatttggtagcaccaatacgtacctcttcacggcgactaagtgccacttcgagacctctctggtgaacctgtacttcccgtacaccactagtgccaactctggtgagaagatggtgttcaacgatacggtatttggtggggcaactcgtaaccacgttgagatgaacactccggggatggacctcacgttcaatacctgctcgttcgactttaccagcggtagtatcatctacgggacggagacttggggttactctaaggtcggccttaacagctgccactttgagggttttgacaacctgtgggttaaggtggatgcacctcaaggtggcttcattgggtccaacagggcaatcactatcgcaaacgctacggtacttccgcgtcgccgctcgaatacgactggcaccaactcacctagccgaatgcacatcgacgctaagtctacccctgtgtatatcagcgggctggacctgcgccacgaggttgtcccgtataccgaggaaatcttcatgacttccccggagaccacgctgattctgcaaggctacctgaaagacccgtacttccagattcctaacaagtcatacatccagaaccgtgggtgggacattgcagatgagaccactgggacactggtgaacagctcggccactatggatgcattgacccgctttacgtgcatcgagcgaaatgctctttcggctgaggttgtggaaggagggacgtctggtaagctgctggcaatgacaggggctggtggttacttcacactggtcaccaaaggtttcattcccgtgagtacgttccagaggattggcggggcaatgtcgattcaggcagcagcgagtaccggaaacatccagtgcacgattggtgtccagtggttcgactacgatggcaacctaatcggaaccgaccaagcctttgcgattaacatgcgagaagtgttcaacaactcttcgctgcctaacttcgccgagggtaacaaccgcttcatctccacgtccacaaggactttccgagcaccagctggggccgctaaatgcaaaccgctgtggcgaatctctggccatactggcgtggttaacatctcacgcttagcatcatttgtgtta

SEQ ID NO: 18 - protein, 875 aa, Artificial sequence
  specific to K11
MDQDIKTVIQYPVGATEFDIPFDYLSRKFVRVSLVADDNRRLLSNITEYRYVSKTRVKLLVETTGFDRVEIRRFTSASERVVDFSDGSVLRAADLNVSQLQSAHIAEEARDSALLAMPQDDAGNLDARNRRIVRLAPGVEGTDAINKNQLDTTLGEAGGILSEIKQTEKDIQDYIENFADDTTSLKGINWVYNSGSANGGETSILITREGPVFAVPTIYINGDRQAVGYHYSYDSGDKTIHLVKPLKAGDFVECVTSEGVLPLSNLLSTPDGASQIGTKSGLTVQDYLNGVKSATILRNIEPAIDGQRIVLSEISPTLGPKSGGTLVYDQSDTSSVDDGYTVFVTAGGKRWKREESYIDVAWFGPNFGLALQTAVNLVDNYVRTVGFYSRKTIYIAAGNYTTDRQIDIPSYVSVVAIGNVNINGASLPVNSYVIRITNKVTGISTTQHSGWNLGSVGGTLRLVGNGSSNQVDGLFVGNTTAMSDVRNVSLYAVATSGVRYGLTFGSTNTYLFTATKCHFETSLVNLYFPYTTSANSGEKMVFNDTVFGGATRNHVEMNTPGMDLTFNTCSFDFTSGSIIYGTETWGYSKVGLNSCHFEGFDNLWVKVDAPQGGFIGSNRAITIANATVLPRRRSNTTGTNSPSRMHIDAKSTPVYISGLDLRHEVVPYTEEIFMTSPETTLILQGYLKDPYFQIPNKSYIQNRGWDIADETTGTLVNSSATMDALTRFTCIERNALSAEVVEGGTSGKLLAMTGAGGYFTLVTKGFIPVSTFQRIGGAMSIQAAASTGNIQCTIGVQWFDYDGNLIGTDQAFAINMREVFNNSSLPNFAEGNNRFISTSTRTFRAPAGAAKCKPLWRISGHTGVVNISRLASFVL

SEQ ID NO: 19 - DNA, 2469 bp, Artificial sequence
  specific to K17
atggcgtttagttggcaagagtctaccgtggcttctggtacccagaacatcacgtgcgacatcgagtacttagataagtcatatattcacgtgtacctcgacggtaaggaaactacggcgttctcttgggccagcgacacagttattcgcctggatacagcactcaccaaggacacggtggtgctgttaatccgtaagacagaacgtgagtacctctacattatgttcgccagcggcgcaccattcattgaggcgaacgtagattcccagaacaagcaattcctgcacctggctcaagagttggtggaggtgcgcgctatcgacgggttctacggtgacattagcatgcacggctaccgtatcacgaatctcggtaatcccgagagttctaccgacgctgcgaacaaacaatatgtagacgacacctatgcagagtttcaagcctcctgggagactcgctttcaggagtttctgctctcctccggctacacatttctgggagagtacgaggctgggccccttacattcacggcccgtaatcagtatatccgctacgatggacagtactatcgtttgaatgctgcgactgacgtaggctttacgactaccggaaccgatgcggccagctttgcgaacgacgttactcactttgttctgatggatggtgacacgctgcggcaagaactggcctcagatgatggagctgatttagttgaaagcaagaagccgtacaccggaacggttaggcgcaaagcgtctaaaatgctggcggaaaccatctccccatgggattttggctgtgtatctgacgcggtatttgacccgggaacgcagcgcctgatagatgggacagataatacctctaatctacaacgaatgctcgcagaggctcattatcacggtgtggtagtagacctcccccttaatggaagatttgccagtaaatccctgtacctgcattatgacgctgtaaaaaacccgtactggactggtcgcccaggtcgcctgactattcgtggaggcgtactggggcatgccactggggacgtagagcaacagggctcggctatattccatattcccggagaaaactcgccgttaatatcaatgattggagaattcagtatttccaatccggcaggaatgggtgggtactttgaattgaattcgttgaacttaattggtagccaggacagctcggatgttcttctattgcaaggcagtcaaggggcaatgaagctggacaggtacactgtaaaggtacttaacccagaagggaatggtataaccgaggctacaacctgggaaaccgtacatatcaacgggcttatccgtggccctgctacaggtgatggttcaaatactggtgttggtttggatattaaatctgacggcactattggtcagattaatatgaagcagtaccttaacgttaacgttatgaagatgggctacagtatccgcgcaggtcgtcgtgagaagaccaacgggactctagggccactggttttcattggtgggcaaacctccggtgcggaccatcacgggatgtggttggatggtggtataatttccttcacgtcaataggtcagcagcatgaaggccaccgtaaaaatggtatccggatagataatgtccttgaggatggaactgttagttctgaccttcctcgcaccattaaattccaacagaactatcttacgggctgtgggtctgttgatgaccactccccagacagttacggtgtttatattgcaaatggcgatggaattgaactggatacaccgacgtttaacctgtcccgtaatggtatcggatttgatgcacaaaatgtcgataacctgttaattcgtcgacccacattccgtaccgttagtgattatgggaaaacgcagggcttcggtatccgctcattctctgatggcgttgccacgaagcgtcaatatcttgagcacccagttttcaaccagacgcatgccacacagattgatgataaagcccgtgaaatatttgggcgcggagcggcagggggtcgaatctcattttcgacaaacacaccgactcctagtatcatccatggttccggtactggtaatgagtcgtatcgtataatcaattttaacaatacgacagccaccactattaccaatattaccggcggcacgccctatcagcgtctgttgattacgttttcgaacgacgcaaccacgatacagcatagtagtaatattgttctgcgtggaggaaaggatgttcaaggggcggtagggaagacgctagagctgtattacacggggtcagtctggcacgaagttggggacccggtgagggcgctcagcggaaccactgccaacaggccgttcagtactgcatttccgggcatggaatacttcgacaccactctgaataaaccaatctggcgaaatgcagcaaataatggctgggttgactctgcaggtactgcagtc

SEQ ID NO: 20 - protein, 823 aa, Artificial sequence
  specific to K17
MAFSWQESTVASGTQNITCDIEYLDKSYIHVYLDGKETTAFSWASDTVIRLDTALTKDTVVLLIRKTEREYLYIMFASGAPFIEANVDSQNKQFLHLAQELVEVRAIDGFYGDISMHGYRITNLGNPESSTDAANKQYVDDTYAEFQASWETRFQEFLLSSGYTFLGEYEAGPLTFTARNQYIRYDGQYYRLNAATDVGFTTTGTDAASFANDVTHFVLMDGDTLRQELASDDGADLVESKKPYTGTVRRKASKMLAETISPWDFGCVSDAVFDPGTQRLIDGTDNTSNLQRMLAEAHYHGVVVDLPLNGRFASKSLYLHYDAVKNPYWTGRPGRLTIRGGVLGHATGDVEQQGSAIFHIPGENSPLISMIGEFSISNPAGMGGYFELNSLNLIGSQDSSDVLLLQGSQGAMKLDRYTVKVLNPEGNGITEATTWETVHINGLIRGPATGDGSNTGVGLDIKSDGTIGQINMKQYLNVNVMKMGYSIRAGRREKTNGTLGPLVFIGGQTSGADHHGMWLDGGIISFTSIGQQHEGHRKNGIRIDNVLEDGTVSSDLPRTIKFQQNYLTGCGSVDDHSPDSYGVYIANGDGIELDTPTFNLSRNGIGFDAQNVDNLLIRRPTFRTVSDYGKTQGFGIRSFSDGVATKRQYLEHPVFNQTHATQIDDKAREIFGRGAAGGRISFSTNTPTPSIIHGSGTGNESYRIINFNNTTATTITNITGGTPYQRLLITFSNDATTIQHSSNIVLRGGKDVQGAVGKTLELYYTGSVWHEVGDPVRALSGTTANRPFSTAFPGMEYFDTTLNKPIWRNAANNGWVDSAGTAV

SEQ ID NO: 21 - DNA, 1962 bp, Artificial sequence
  specific to K19
gtggctacaactccaactacgggtgatatccccagcaatgctgcggtggacctcaagtttaactcggaacaattcgaccgagtaatgaattctgacgatctgacttatacagatcgttttggtaaaaaacgtattacgatgaaaggagttcaggaactcgctaatggcttccaggatactttcacgaatctgttgggttctcctgatggatttaaactgatcggcggggtaaaatcttttgatacgcttagatcaaccccagtaagaaccgaaggccagcgtattttcctcaagtcctattatgaaaacggtaataccggaggtgggatattcatcggtcacatcggtactaagttagatgatggtggtaccgtggcccagggcatcgggtattactgggaaagaatgtatcaatctacagtttcagttaacgattttggggctgtgggggacggcgttaccccggatgacgtaggcatcaaatatggcttggactgggttagcgccaaacctaaccgaaaactgacgtttgatcaaaactgtctttacctacataacaccccactaactgtaactttcaaagccggtaacaccactaactgcgaaatagagatgttgggcagcctatacccatcgagttcggtcgccgacgcccttacaatatccgaagccacttattgtaaattcaaattaaaggtgtacggttctgattacgggactacgtcgtttccagattatagtcaggcagacccagttggtgcaagacaagcgttcgttataaattcttgtaggtcctgtgaaacgaaagtagagggatatggttataatggtagggttcttaggacaaaagccaccggcacagttaagatgtctttcaatgatatctcgattaaaacaggtgaaggaagttgcgcccaagcggcttatctgcagggctctgccgatgcatttggaaaaataagtcacgggcagacccaatgggactactttgggtctgttttagataaactcactgatctcaccattgtttattgggagtacgggaataagaactccgcggttcccgcgatgctcatgaataattgcggaagtgttgaaatcgggaatctgaccggtggatctacttgggattcggatacatccacaacccttaaaattgtgggtggtcagggaatccacgcttcaagaattcaggttggtgaagcctacaccggcctgtcaatagtagggggtggattaataagtgataaaccttcggtgactattgataacctcttaagctataagactaatcaggctgtagccctcaacaatacaaccggagtaaaaatattatccggattatgcgataacacttactacggggtgaggtattcaggtaatatcaacaattgtcgcgttaatatggacggtagaaacaatttcaccgccatgcattcggcggtgaccggggcggcgataaagagcttgtccatcggcggggatttgtattctgaaacaaccacggcctttataaattttggatccgtgaccgtaaataaacttaatgttaacgacacgaatgtaaccactacaggaaaatatttggttcttcccgctgataaccagtgtatcgttagaggtggtcagtggtcaggtagccttgatccgacacctatatccggcagaccaaaacacatctcaaacgttcagggaatcaaaacggcatatttgaacgccggattacagtttttatccgggacggttcaaggtgccactatcacaataaaccatgggctgtgggcgatgccatttgagatatcggtcatgccatattcggttgcttccgggaccttccctagcgggaatattgcggtgaaaacgttgtcttccactcaggtggttttgatgtacacaggtgcagccgccctgaccggagatatgtaccttctggttaacataaagtcggaagctagagtcgat

SEQ ID NO: 22 - protein, 654 aa, Artificial sequence
  specific to K19
VATTPTTGDIPSNAAVDLKFNSEQFDRVMNSDDLTYTDRFGKKRITMKGVQELANGFQDTFTNLLGSPDGFKLIGGVKSFDTLRSTPVRTEGQRIFLKSYYENGNTGGGIFIGHIGTKLDDGGTVAQGIGYYWERMYQSTVSVNDFGAVGDGVTPDDVGIKYGLDWVSAKPNRKLTFDQNCLYLHNTPLTVTFKAGNTTNCEIEMLGSLYPSSSVADALTISEATYCKFKLKVYGSDYGTTSFPDYSQADPVGARQAFVINSCRSCETKVEGYGYNGRVLRTKATGTVKMSFNDISIKTGEGSCAQAAYLQGSADAFGKISHGQTQWDYFGSVLDKLTDLTIVYWEYGNKNSAVPAMLMNNCGSVEIGNLTGGSTWDSDTSTTLKIVGGQGIHASRIQVGEAYTGLSIVGGGLISDKPSVTIDNLLSYKTNQAVALNNTTGVKILSGLCDNTYYGVRYSGNINNCRVNMDGRNNFTAMHSAVTGAAIKSLSIGGDLYSETTTAFINFGSVTVNKLNVNDTNVTTTGKYLVLPADNQCIVRGGQWSGSLDPTPISGRPKHISNVQGIKTAYLNAGLQFLSGTVQGATITINHGLWAMPFEISVMPYSVASGTFPSGNIAVKTLSSTQVVLMYTGAAALTGDMYLLVNIKSEARVD

SEQ ID NO: 23 - DNA, 2133 bp, Artificial sequence
  specific to K21
atgaccttaccaactaagaatcctattcctagtgggaatattttggatcaactgttcaacgctgaaaaaatcgacgagtttgttggatcttcggaggattattatactgaccggtttggggttaagcgcctcacgattacgggtctcaataaactttccgctcaaagcaatgctaatgcgatctcgtcacttggtttttacgaagatggcgtgatccaagtaagagataggaaccagttaattcgttacagcgacgtactttatcaaataaaccccgacgtcactctgccttttacaacaaccgggactgacgccacgagctgggctaatgattcttcaaaattcacccccgttggagccggtaaactcagttatgatctccaaactgatttgggcggacagatagtcagtttaaaaattaataaaacgtcttcgaagaaaagaacctctgcggagaaggcgacggacagacccaatctccttgattgggataccgattctcaatccgatgacagcatgaggttaagaaaagccctcgttgatggggttgaccatatccaattgcccggcgtattagaattaggccgcccgatttattttggcgaagtggatatctctactgctttacgatttgagggggttggttcccaagggtttaaccgtaacggtagtgtgataatcaaagcctctggcgcggcttatgggatgcattttaacggtgtgggggcggggacacgacccgcgggaggcggactctacaatatccacctttccggacaagccagcgccgatacaggaccgttagttaaagtaacgtcgtggtcttattttaaagccattaacgtcgggtttaacaacataagcgattatggacttagattaaaagacgttatggaatcgacgatctcgggctgcctgtttaggagactgggaagtaactccactgggtgtattttgctcgacgattatttgacctctcaaaacaataacgtaaacaatttacacattgtcggatgtacctttggacttaattccggagaatggattaaagcgactcctctttctaatattgatgtcgtctggatacaaaataataagtttgaatatgatgccgctccgatcagtcctaataccgacccccagtacgtcatcgatttaggtaaggcggcgaaaacattcatcgatcataatacatttacttatttcaatacccctaaaaacaactacgccggcatactgagaatgcagtcgcagtgtctttccacgactatgtttaccaacaatcagatgttcggatgcgaaggtaacgccgggcttattgaaggaggatctttattcgctagagataacttcaatactctgggggaaggaactggaactattggatttagtgtaactagcactaaacgtcaggatattgaagatgttttcaatatcaataataacggtaacttggttagccggcctaaggcgccgaccggtaactttatttcctgccataagttatcggggactgtggcaaatctttttactcctgatcctggcgcgacgtattggaccgtaatgaacgttcctgcttccacagagatccggcgcttccagttaccagggcaacttttgaatgagggcgcacccgtacgagttagggtgcgggttaaatgtaccgatacggcgggagcggatggaagtgttcagatcatagcggacgataccaccctctcagcttctactgttacggcttcagccggatggcagactgtggagtttttaataaaagggactttgcttacttccggcgttttgaaaataatgaactccggtacggtgaatgtcctatttgacggcatttattatgaaaaggccgaatatgtcgactggaactttgcctttccagttgggacattgacccctggacagcagctcatatcggatgttcaatcatcggcagatatcgtcggtatagctaacaaaataaaaggctgcggcggcgtgtggttcaacagcagcgctgttgggttgctgttcaatccttcgacttatcagcccggtaacgcgtttagggttattgtttataatccagggactgccaacgtggtcacgtcgataacccggtgtacggtgagggttattttg

SEQ ID NO: 24 - protein, 711 aa, Artificial sequence
  specific to K21
MTLPTKNPIPSGNILDQLFNAEKIDEFVGSSEDYYTDRFGVKRLTITGLNKLSAQSNANAISSLGFYEDGVIQVRDRNQLIRYSDVLYQINPDVTLPFTTTGTDATSWANDSSKFTPVGAGKLSYDLQTDLGGQIVSLKINKTSSKKRTSAEKATDRPNLLDWDTDSQSDDSMRLRKALVDGVDHIQLPGVLELGRPIYFGEVDISTALRFEGVGSQGFNRNGSVIIKASGAAYGMHFNGVGAGTRPAGGGLYNIHLSGQASADTGPLVKVTSWSYFKAINVGFNNISDYGLRLKDVMESTISGCLFRRLGSNSTGCILLDDYLTSQNNNVNNLHIVGCTFGLNSGEWIKATPLSNIDVVWIQNNKFEYDAAPISPNTDPQYVIDLGKAAKTFIDHNTFTYFNTPKNNYAGILRMQSQCLSTTMFTNNQMFGCEGNAGLIEGGSLFARDNFNTLGEGTGTIGFSVTSTKRQDIEDVFNINNNGNLVSRPKAPTGNFISCHKLSGTVANLFTPDPGATYWTVMNVPASTEIRRFQLPGQLLNEGAPVRVRVRVKCTDTAGADGSVQIIADDTTLSASTVTASAGWQTVEFLIKGTLLTSGVLKIMNSGTVNVLFDGIYYEKAEYVDWNFAFPVGTLTPGQQLISDVQSSADIVGIANKIKGCGGVWFNSSAVGLLFNPSTYQPGNAFRVIVYNPGTANVVTSITRCTVRVIL

SEQ ID NO: 25 - DNA, 2340 bp, Artificial sequence
  specific to K22
atggcattcagctggcaagagtcggtaaagcctgcaggtactcaggatatccagtgcaatatcgagtacctggataagtcctatattcacgtttacttagatggtgctgagactactgccttcacttggaccagctccaccaatattcgtcttaactcaccgctgtctgcagggacagcagtgctcctcattcgtaagactgaacgggagtacctctacattgagtttgctagcggcgcgccgttcgtagagggtaacgtagacacccagaatatgcagctactgcatctggcgcaggagctggttgaggggcgttatatagaaggcttctatggtgacattaacatgcaccgctaccgcatcacctatgtaggagaccccgtggacgcgctcgacgctgcaaacaaacagtacgtcgacggcggagatgcccggttagaccagcgcattgacgcagaacatgccgcgtgggtggccggtgacgccgcactggaatctcgcgttgtgaacttagagcagacctactttgacgctaacactaacagtttcccatggtggactatactgacgtctgatacggacacggtgacaccgggtatgccttttaccaaggccaaggttagagtgaacggccttactaagactgcgggatactcctacaccgttgactccggtgtagtaaagttcaccgaggtcttaccagcaggtacgttggttgatatgactatcggtatcgacacagaggccgacactagcgccgtatcctccatcttggaactgctaactgcaccttccggtgcctcactaattagcagcgggaacgcacctgtgtcggttctgctacgccgcagcatcttcgaatttatgtctgctggagataggacgctaataaccggtacggtcggcactgaggtgttggtggattacgccattgccgcggcagttgctgccggggtaactgagctgtacttcccacctgtacctggtatctacgtagtggggcaaaccccggtcacgctaccggctgggttttcaattactggggtggcggctaagccctacacagcgtcttctaatgcttcttttaactctagaggcacggtgattaggctggcttctggggccacagctccgttcatcctgacaaacaggcaccgatttctaaacgtaatactggacggtaggaactcttccgtaaacttgatgaagggggtaggctcagaccaaactcagtattgccgattcgattcttgtgggatttaccgctggcttaacggtattggtggctccagttcctctggatacacggccactgtacaggtaattgggtgtgctcttgccagtaactacaggggtgttcgtaacgtaattgattccagattcacggactgtaccattaatgccaacacatataatggggttgagcttaatgctggggccaataacaacagcttcctgaacgttagaaacgagtggaacggcgcgcacaactacttcgcctccggggctaagcgtaacgtggtttgtggtgagctatgtgatcgtgcaggcctaagtggctttgttgcagtgaacggaggtcagtgggtagtttgtggcgtaacagttcagcgctccgggaagaacgcagtggttggcagtgtagatgatgcgcacttccagttagctggagggtcttcctctattatcatcaacggcgtagacactctagcgggtgccaatgatgatggtagcggtacatctacgccgtcttacacgctgtcgacgtctggggcgaattcggatgaaaagaccttcatagccactgggtctaggttgggagggttcaccggaacgtcctggctacgttctggggttgtgaagaacctgtcggtgctggggtgtgctggtattccggacgttaagaactttggatttagccaaagcgaagatggtgctactcgattgggtgacaaagtgtcttccctcgctctgtcgggtgcagggagcactgcaactctaaccttcgcagtaagttctgacggggcacgttcgcagtacagtgagcccctagtcaggaagttagagataaccgcccgaaacaacaccgacaccgggtccgtgtctaggttctatgcagacttaattatctccagagaacttgcgacagccgctgtggtggtggatccgtcttccgttaaaaccctctccacgcttagtgggggtacttggggccttgcaagcgccagcccgactggggtgtctgtaacccctacaatctcagccgacggctctactctaaccgtgacgctaaccgctgtggataacgcgccaagacgtatatgggcacaattgagaggt

SEQ ID NO: 26 - protein, 780 aa, Artificial sequence
  specific to K22
MAFSWQESVKPAGTQDIQCNIEYLDKSYIHVYLDGAETTAFTWTSSTNIRLNSPLSAGTAVLLIRKTEREYLYIEFASGAPFVEGNVDTQNMQLLHLAQELVEGRYIEGFYGDINMHRYRITYVGDPVDALDAANKQYVDGGDARLDQRIDAEHAAWVAGDAALESRVVNLEQTYFDANTNSFPWWTILTSDTDTVTPGMPFTKAKVRVNGLTKTAGYSYTVDSGVVKFTEVLPAGTLVDMTIGIDTEADTSAVSSILELLTAPSGASLISSGNAPVSVLLRRSIFEFMSAGDRTLITGTVGTEVLVDYAIAAAVAAGVTELYFPPVPGIYVVGQTPVTLPAGFSITGVAAKPYTASSNASFNSRGTVIRLASGATAPFILTNRHRFLNVILDGRNSSVNLMKGVGSDQTQYCRFDSCGIYRWLNGIGGSSSSGYTATVQVIGCALASNYRGVRNVIDSRFTDCTINANTYNGVELNAGANNNSFLNVRNEWNGAHNYFASGAKRNVVCGELCDRAGLSGFVAVNGGQWVVCGVTVQRSGKNAVVGSVDDAHFQLAGGSSSIIINGVDTLAGANDDGSGTSTPSYTLSTSGANSDEKTFIATGSRLGGFTGTSWLRSGVVKNLSVLGCAGIPDVKNFGFSQSEDGATRLGDKVSSLALSGAGSTATLTFAVSSDGARSQYSEPLVRKLEITARNNTDTGSVSRFYADLIISRELATAAVVVDPSSVKTLSTLSGGTWGLASASPTGVSVTPTISADGSTLTVTLTAVDNAPRRIWAQLRG

SEQ ID NO: 27 - DNA, 1749 bp, Artificial sequence
  specific to K24
atggctctagttaaattagtgtctgcacaatccccgactgggggtcagtatgactgtaccgatatgtccgcgttgcggacttttaagtgcgcgcgagtaggtcaggaggttgtactacgggagcatactgcgggttcaggagcgggcggcggtgtatggtactgtcacgcactgactgcgggttctgcggtagatgataatggatgtcagattatcaacaaccacggacaggttatgcgccgcaaagccgtaaaggagttaacctcaagcgattttggattgcaggcaggcgataccattgacggcgtgcttcttaatatgtacaaggcttcgcgtacatttaacatttatgaagcaaaaattgagaacccaggatttgataaagggtatgtattacaaggtggtctgcggttttactgtggggataagccattttatatactgtcctactctctaggaaccttgagagggccaaatttatggcatacaggggataacattggtattaccttttccagatttaagacggatggtacagctggggatttctggttagctggaggtatccgtggattccgtgttattggtgccacttcgtatttggtggaagggaatgctggggtttatgctacaccagtaaggctctccgacatgtggcaaggtgaagcctgcgatttgtttgttactggatacacaggtaacaccaatggcgcagtggtatctctgtataacgagtttgcgtggacagaaggttcccgtgttgaaaacgtaatggttcgcaaatcgcggcgggggattacgttcttacgtaaccacaacggcattgcaactgatagcttcttccgaccggtggttgacctctcatttaatcatggtgttcctggacaaccaacgcaagtaatggttgttggtgatggaacattagcagggcaatgtcttgtatatggtcacgatattaaaattacccagtggatgagtgctggagcatggcatgatattgttcgtcttgaggactacagcattatctctgaggatggtgttattaaaatagttgcggatgggtacggaatatccaaaactaccgtgccgactggcgaagttgtccaccatattaacgtgcgcggactcaatgcccggttcaggagcagagtggaaacctggtcaaatcaggccggtggttgggggctggatttcctgaacattatcttccagtccagtatgtatactaatgccatgccattttttgagtctgagtttgacgcgctgccaaccattaaccctgtcggtatgaaaatacgatttaacggtacgttcactgttgatgagcggcagtctggcaaggtttacacccttaacgggctaattccaggaatgacactaaaagtcaaagtgacatctcgcgagggtaataacatttataatgtctccgtgcaggagtggaaggtgtttgttcgtagcactgacttcccatgtatagtcgtccctatgtccggaagtgcaaacatcgcaactaccgatgggttggcgctcgtaacgcctgcgggggctactgcgacattcctcaaaacagttacacctactccagccagaaactttattggtcagagctatggtcttactgtaaagaatgcgaatgatgataacagcttatcctatgctgtgaactcaggtcgtaagattcgctttgttcttccggctaacccaactgcaactacaacatccccttattctgttgagatagaggtactt

SEQ ID NO: 28 - protein, 583 aa, Artificial sequence
  specific to K24
MALVKLVSAQSPTGGQYDCTDMSALRTFKCARVGQEVVLREHTAGSGAGGGVWYCHALTAGSAVDDNGCQIINNHGQVMRRKAVKELTSSDFGLQAGDTIDGVLLNMYKASRTFNIYEAKIENPGFDKGYVLQGGLRFYCGDKPFYILSYSLGTLRGPNLWHTGDNIGITFSRFKTDGTAGDFWLAGGIRGFRVIGATSYLVEGNAGVYATPVRLSDMWQGEACDLFVTGYTGNTNGAVVSLYNEFAWTEGSRVENVMVRKSRRGITFLRNHNGIATDSFFRPVVDLSFNHGVPGQPTQVMVVGDGTLAGQCLVYGHDIKITQWMSAGAWHDIVRLEDYSIISEDGVIKIVADGYGISKTTVPTGEVVHHINVRGLNARFRSRVETWSNQAGGWGLDFLNIIFQSSMYTNAMPFFESEFDALPTINPVGMKIRFNGTFTVDERQSGKVYTLNGLIPGMTLKVKVTSREGNNIYNVSVQEWKVFVRSTDFPCIVVPMSGSANIATTDGLALVTPAGATATFLKTVTPTPARNFIGQSYGLTVKNANDDNSLSYAVNSGRKIRFVLPANPTATTTSPYSVEIEVL

SEQ ID NO: 29 - DNA, 1752 bp, Artificial sequence
  specific to K25
atgggaaattttatacaacctaaaggttcaacttctactgaaatcgctagagaaattttatctaaaacttattcaataaattattctgaaatagattttataaaacaaaatctttcagttaatggtttaaaacttcttattgatccaaatactcaatatatatggggaactatttcaagtttagaaactggaacaatttcatcatggagtatagatagtactggcgaaattatgactgtattaactactaatggcactttaacattaagaaaaatttctgtttctacttcaacaacaaccgcaaattctatatataattttatgacatctgatgatatttacaacataaaaaatgtagttgggattgaaattaatgttgattatgctttacaaaaagcaataaattctggattaatgtcaatttattatccaccatctaaaggtatatatgtacatagtaatgtatgtacattaccatcaggattcaatatgtatggtcaaagtagaaaaccatacactgtttcgaatgatgcatcatttaataattgcggtactgttattagattagcatctggttcgcctggtatttttgttctttcagggagacatactttcgacaatattgtatttgatggtagaaacaacacagtgggttctatgaatgctacatcacaagtttctgggtgtagattcgaaaaatgtggattttatagatggggtattggtttaggaagaactagtgggtatgtagcaaccgtttatgctcgtggttgtaattttagtggtaataatacagcaatgcaagactggattgactctcgtgcagtcgattgtacaataaatgcacaagtctctcgtggcattgcgatgcgaacaggagctaataataatgcatgggttgggtgccgagtagaatggaatggaaccgatggtttttatttttatcaatcagtaggtaatgtaattactggggaattgattgaccgtaacggatatgcaggaattactgttgccgatggtgcaagtgtatcagttacaacctgctcaatacaacgaaacggaagaatatcctctaatacaaataatggggctaatatattaattaatgattctgggataattttattaaatggtaatagatttacttctggtgtagatgacggtggtactggtgtattaacaccagattatgatattatatgtgctggtggtactggaaaaatccttattgcttcaggaaattcgttttcgggtggaaacttaggctatatgaaagaagtaactatagctaataaagtaataaccggaaactatggtttacctgatatagttaatacagggacatatcaaaaatcatctggtttggttaaaatggggaatacatctactggaacattaccgccagcagcatcaaatggaacattaacattatcattaagcagaccagcaatgacacaatatatgattccacaaaaaatagttcttgagatatcagcaagagatactataggtggaagagctgaatattttacagtacctctattgtgttcatgggaaagcaccgtacccgtaattaatatgatatcatcgaaattagatacatatccagacaatgtatggggtccaagtacaaatacacctactggggttcaagtatctgttagtacaacatctgatggttctactattactatcaacttagtatctatggatacaagaaatagacaaatacaagcttatattagaggtgca

SEQ ID NO: 30 - protein, 584 aa, Artificial sequence
  specific to K25
MGNFIQPKGSTSTEIAREILSKTYSINYSEIDFIKQNLSVNGLKLLIDPNTQYIWGTISSLETGTISSWSIDSTGEIMTVLTTNGTLTLRKISVSTSTTTANSIYNFMTSDDIYNIKNVVGIEINVDYALQKAINSGLMSIYYPPSKGIYVHSNVCTLPSGFNMYGQSRKPYTVSNDASFNNCGTVIRLASGSPGIFVLSGRHTFDNIVFDGRNNTVGSMNATSQVSGCRFEKCGFYRWGIGLGRTSGYVATVYARGCNFSGNNTAMQDWIDSRAVDCTINAQVSRGIAMRTGANNNAWVGCRVEWNGTDGFYFYQSVGNVITGELIDRNGYAGITVADGASVSVTTCSIQRNGRISSNTNNGANILINDSGIILLNGNRFTSGVDDGGTGVLTPDYDIICAGGTGKILIASGNSFSGGNLGYMKEVTIANKVITGNYGLPDIVNTGTYQKSSGLVKMGNTSTGTLPPAASNGTLTLSLSRPAMTQYMIPQKIVLEISARDTIGGRAEYFTVPLLCSWESTVPVINMISSKLDTYPDNVWGPSTNTPTGVQVSVSTTSDGSTITINLVSMDTRNRQIQAYIRGA

SEQ ID NO: 31 - DNA, 925 bp, Artificial sequence
  specific to K26
atggcattcagctggcaagagcaaattaagccagctggtacccaggatatccagtgcgatattgagtatttggacaagtcctatattcatgtatacctagacggggaggaaaccactgggtacacctggaccagctctactaatattaggctgaacacagccttagaagcagataccacggtactgctaatccgtaagaccgagcgagagtacctgtacattgagtttgctagtggctccccgttcatcgaggtgaacgtagactctcagaacacgcagttcttgcacttggcgcaagagctggtggagggtcgggctatccccggattctacggcactattagtatgaacgggtaccgcataaccgacttagccaacccaatcaactcccaggatgctgctactaaggcatacgtcgacgccgctgacgccttgctgggacagcgtattgacgcagaggccgctacgcggaaggccgctgacgatgccttgagtatgcgcacgtccgctctggagaacacctttataagcggagtggagacagtaagttacccttggagtacagtgttagccgaggctacagacgaagtaactcccggcttggccttcactaaggctgtcgtggaaattaacggagttgggcaaattcgcggttacagcttcgagatagtagacaatactatactatttgccgagactctccctgcgggtaccattgtagctgccagactgggggttgacgtaactgcaggtgacggctttgctacacaagcgtctgttgattacttagctgactcgttgggggatttggcatatctggataaagcagcagctgtgtccgacgcaacggatacaggtgatgtagtagtacaattaaatgcactgctggcagccctgcgcaccagcggggtgctgacgtcgtaat

SEQ ID NO: 32 - protein, 307 aa, Artificial sequence
  specific to K26
MAFSWQEQIKPAGTQDIQCDIEYLDKSYIHVYLDGEETTGYTWTSSTNIRLNTALEADTTVLLIRKTEREYLYIEFASGSPFIEVNVDSQNTQFLHLAQELVEGRAIPGFYGTISMNGYRITDLANPINSQDAATKAYVDAADALLGQRIDAEAATRKAADDALSMRTSALENTFISGVETVSYPWSTVLAEATDEVTPGLAFTKAVVEINGVGQIRGYSFEIVDNTILFAETLPAGTIVAARLGVDVTAGDGFATQASVDYLADSLGDLAYLDKAAAVSDATDTGDVVVQLNALLAALRTSGVLTS

SEQ ID NO: 33 - DNA, 3882 bp, Artificial sequence
  specific to K27
atggggtattttcaaatgaccagaaacgtagaagaaatcttcggtggtgtagtcgttgcaccacaccaaatcccgttcaaatacacttcaaccaacggtggggaaactttcctttctctgccattttatcctatcacagggtttgttactatcaacggtggcgttcaggtcccgcttgataatttcgaactcgatgggaatacattaaacctcggccgcgagctggaaccaggggatgtcgtattctgtttgttcgataaaatcatgtctcctcaggatgcgagcaacaatgcagttcgtatctacaaattcctttctgttggtggtgaaactgaatttacacctgatttcacaacatatggtgtgcagtctttgtacatagacgggaaatacaaaacacccggcgaagattacaattatttcaaaacttccggtaaagttgttcttgatacagcgttgccaacaggtgtttgggtcgttgctgagatgtcaattaagcaaaatatcccggcgctggctggtgacaatggcgcaagtgaaattggcacagaatccggcaagaccgttcaagagactctggatgacatcggttataacttggcttccgtagaaaaactgatgacagatgtaacagatatgtcaccagtacacactcatggtttctataagagtatggatggtgggcatggtgactggtataaaacaggtaatactgactcgaccaaagctggtacacatgacgtaactaaagccttggtttataatgccaaaggcacagaatatgctttaaatgtttctgtggataatattagtgttttagctaatggagctaaatcctatgattatgccgaatgtattgataagaccacagataactttgtatgtttagggcaagtcatcaatggtattgaatcccaccttacacttggcgtgtctactgctaataacatcgatacctatgatggtggtaaacgtaccaacatcattgtccctactgatagttatcgtattggtaaagaagctgccaagctgtactcgggggttgcttaccaactgaacgcttcacgtatctttgtatttgcgggtgcatcctatcaatactctgtcactggtaagcgcttaaatggcttccagcacggtgtagatgagatcaccgagaaatgggaagccgtgaacaggggtatctattggggatctgtcagcttgcagaatacatccattcatgggggtactctatttggtgatcacacaatccgtagcttgcgggatgagtgctcctctggtgtgggtgtgctggctctgaaccctgaaggtttctctacttacggtttgataatcagggaaacgttcatgtgggctatggtggaaacgactgccgaggtagaagccactgagtttaaccagaatggccatgcgttcgataacgacagtattgactataagtacatagttgatgcttgggttaatgctggtattacttcccgttttggtaactttaaccgaaccgcgcattacaacagtaagttcatgggtggccgtcgtggtacataccgtaatggttgtgactggtcagctctgtacaactgtgaagtaaccaaccgtctggcgtggcgtaatgcagccaacgtttctggtgaaataccggaatacattgcagtttgtactggtactgcaatgcatgtttctggtggttactgggggccagcagcagcaaaagattataacgcgcgttatggtacagtatatggtacagcgcagaaccatgtattcactgctgtgtataccgagtggacgtataacttctacaccatcagtgcttggggctttaatggtaaagcatcccgtttgcaaggtctccatttagacctcgtcagtgtgtataaagataacttcaccgaatactctcagattcgttttgagggtggctgcttcggtactattgatgacggcggtaactacacctacccggaagggttctaccattatgacacacctaatgggcagaccgcatacgctataggatcccctgtgcgtgatactggtgcgtttcgccataatggtttcgacttcaagtatggcccgtataacatgtacctcactgcgggcactgactgggattcctggcgtgatcgcccgtatgctaaggaaatgttcaacccatatggtatgcagattaacagtgggactgcattcctgccttggcagattcctgcaactaaatccatggtctgtttctggattaaggacttaactggcaacttcgatccacgaaacatcgtggcgtggattactgctgcaagccaggatggatcagcaaacacagatgaagcgctgtacaagtcctttgctgagaaggttgtagactttggtaacggctataagatgcttatgctggcacagaaacgccttagtgcgtgggatggtcagtacacattcgcccgcaatgccaacatcaccgtaactgtgccagctgagaccccgattgttctcaaggctgtggaagcatacaccgggggtattccgttattccctaacgggtgcggaaactataccccggaatctagtggcactagtatcctgagtcccgtgactaatcaggttgggctggatagctcccttggtggtggcctcttctttaatggggatattattgggccttgggtgcatatgcgccgcactgcttctggctaccgtttctcaccaagcctgaccaatggatatacgcttgcgaggaagatggtgactggcggctatgctctggactccacatttaaggtggcattcagcgctacaattacggcggtaaactctaacaacaccactataattgaagttcctacagcgcagttaccatatatcgcagtaggcattccgctttatgttactggtggatcttctacatctgctaccggaactttccatctcgtcaagcgtattgctaatgcagatggaaccagctctgcacggtatttggtgcaaggtgtattgggtgctgttggtgatgtgctcaccgtagaccaaaaccagctgtcaagttatacgttctttaatgatatgaactataacgccctgactgctgccactttagtgcttacaggaacatcacaagctaccgcccaccgttcctctgtatctgctggtatcggctacggcggtgcatctggcactaaagcgatggagtggtacttcaatgggggcaccacaccttcgcacagactggttgctacgacagtatccggtatgactctagaggcgggtggtaatttttcagtagtcgggaatacgttcccatctgctgatggcacctattctttgggtacatcgtctagtcgttggactcaggtgtttgcaactaacagtaccattgcaacatcaaaccgtgataaaaagacaaacattcgtcagattactccagttgaggtatcagcattctatgaaatagcaatgctcaactccgtctggcagtggatggaaaaataccaggtggagggtgatgatgctcgtcttcatagtgggccaaccgtacaggacgccattgaaattatggataagtacggtttggattggacgaagtattcggcattctgttatgacaaatgggatgcacgggatgctgtcatagaaacatgggatgcagaatatgagactatcccaggcactcctgccgaatatgatgaggaagggaaactcattgttgaggcggttcctgaagtcaaagttctggtgcgtgaggcaggcagtaaagtaatagaaccggcactggaagccggagaagattatgcattccgtaaagaggaattactgttctggataaccagagctatagttcaaaaacaaaaagacatcgaaattagattatctgatttagaaagtaaatttaaa

SEQ ID NO: 34 - protein, 1294 aa, Artificial sequence
  specific to K27
MGYFQMTRNVEEIFGGVVVAPHQIPFKYTSTNGGETFLSLPFYPITGFVTINGGVQVPLDNFELDGNTLNLGRELEPGDVVFCLFDKIMSPQDASNNAVRIYKFLSVGGETEFTPDFTTYGVQSLYIDGKYKTPGEDYNYFKTSGKVVLDTALPTGVWVVAEMSIKQNIPALAGDNGASEIGTESGKTVQETLDDIGYNLASVEKLMTDVTDMSPVHTHGFYKSMDGGHGDWYKTGNTDSTKAGTHDVTKALVYNAKGTEYALNVSVDNISVLANGAKSYDYAECIDKTTDNFVCLGQVINGIESHLTLGVSTANNIDTYDGGKRTNIIVPTDSYRIGKEAAKLYSGVAYQLNASRIFVFAGASYQYSVTGKRLNGFQHGVDEITEKWEAVNRGIYWGSVSLQNTSIHGGTLFGDHTIRSLRDECSSGVGVLALNPEGFSTYGLIIRETFMWAMVETTAEVEATEFNQNGHAFDNDSIDYKYIVDAWVNAGITSRFGNFNRTAHYNSKFMGGRRGTYRNGCDWSALYNCEVTNRLAWRNAANVSGEIPEYIAVCTGTAMHVSGGYWGPAAAKDYNARYGTVYGTAQNHVFTAVYTEWTYNFYTISAWGFNGKASRLQGLHLDLVSVYKDNFTEYSQIRFEGGCFGTIDDGGNYTYPEGFYHYDTPNGQTAYAIGSPVRDTGAFRHNGFDFKYGPYNMYLTAGTDWDSWRDRPYAKEMFNPYGMQINSGTAFLPWQIPATKSMVCFWIKDLTGNFDPRNIVAWITAASQDGSANTDEALYKSFAEKVVDFGNGYKMLMLAQKRLSAWDGQYTFARNANITVTVPAETPIVLKAVEAYTGGIPLFPNGCGNYTPESSGTSILSPVTNQVGLDSSLGGGLFFNGDIIGPWVHMRRTASGYRFSPSLTNGYTLARKMVTGGYALDSTFKVAFSATITAVNSNNTTIIEVPTAQLPYIAVGIPLYVTGGSSTSATGTFHLVKRIANADGTSSARYLVQGVLGAVGDVLTVDQNQLSSYTFFNDMNYNALTAATLVLTGTSQATAHRSSVSAGIGYGGASGTKAMEWYFNGGTTPSHRLVATTVSGMTLEAGGNFSVVGNTFPSADGTYSLGTSSSRWTQVFATNSTIATSNRDKKTNIRQITPVEVSAFYEIAMLNSVWQWMEKYQVEGDDARLHSGPTVQDAIEIMDKYGLDWTKYSAFCYDKWDARDAVIETWDAEYETIPGTPAEYDEEGKLIVEAVPEVKVLVREAGSKVIEPALEAGEDYAFRKEELLFWITRAIVQKQKDIEIRLSDLESKFK

SEQ ID NO: 35 - DNA, 1689 bp, Artificial sequence
  specific to K28
atggctttagttgatatggtaactgtaggtcctggggacctgacacacgcagagtcctacggggaccttaaaacaaaagtaccgaaagcggccggtcagcggattcgcctgctatcgcacatccaaggatgggcggcactgtcacatggtcccgtaggtggcggggagtttgtggctcgtgcaggcgccgctgttgatgatggcggttatgtctgtgtgcccacggggcaggcatcgtactactggcagcgtatttcccaaaatcccggtaaggtttgtgcaacagagtttggcctatatgatggggcgggcctggatagcatcctaacgaagtccataggatactgtattaaaaactcattggggcacctttcaattccagcccttggctctgcggggtatacgcttgctgggggacttgagtttgttaacggcactaacatgctcattattgaaggcccgggaatggcaaccaaaggtaccagcccggtaataactcacacaggtgcaaatatcggacttacgttcaagcgtaattcgcaagcgcagagtctacttaatggggtagttcttaaaaatttcacggtagttggtaatgcgctggctactgctttcgtccggttctcagatttttatggtgggtcggtatttgactccgtgattcgtgattacactattggaacagcgatagatgtatataacgacaagggctggactgaggttatcagggtagataacgtcgttgtaagaacgtcacggcgtgggatttggttccattcaaaccctgcatctactgactggcagacggtgtctttttacggtgccaaaatttctaactttgctttccagcatggcatcgctggggcttctgaaggaatctatgtcggtgacggctcacgcgccgataacttatataactgcgatatcgacatgatggggtggtgggaaggcggcggcaatagtacggctctttacgtggcggataaagcgcgcgttgatggctttgctaacttccgatatgatggctttgctgcaagcgcaatgacgtcgagctcgcaaccgtgccgactagtgcggaaggctgggctgactggttacgttaagctgaactgcagaaactataagcatgaagccggacttggattaactgctggagtaacccagttaacaatccgtccatggttggccatcgcggaagcagctgccggtgtagctacaccacaccctaccctccccggtgaaagcatagtcagtgtaccaggaatgaagtgcaagctggttgggacgttgtttaaggggcagaactcagttatctctgttgtcgggatgcctccgttccatcggtacaaggtaactacacgctgcggattgtctagtactgcgcagcagcagtacatcgtgaatatcccgaacggggctaacgggggcatcactacccgtactgattctgttccagctgtaaccactgacaccgacaccataataaacggtactactgcggaaagtacgtcaacctcaacggcgaagaataaaaacttcgagcctgtttatatctctaacgcgggcagcttggctgacaacacgttcagcaatacgaacaagcagggttttgatattcacctggatggtacacaatctaacgttgttaacgacgagtatcctgtgtctatcgagattgaggctattgat

SEQ ID NO: 36 - protein, 563 aa, Artificial sequence
  specific to K28
MALVDMVTVGPGDLTHAESYGDLKTKVPKAAGQRIRLLSHIQGWAALSHGPVGGGEFVARAGAAVDDGGYVCVPTGQASYYWQRISQNPGKVCATEFGLYDGAGLDSILTKSIGYCIKNSLGHLSIPALGSAGYTLAGGLEFVNGTNMLIIEGPGMATKGTSPVITHTGANIGLTFKRNSQAQSLLNGVVLKNFTVVGNALATAFVRFSDFYGGSVFDSVIRDYTIGTAIDVYNDKGWTEVIRVDNVVVRTSRRGIWFHSNPASTDWQTVSFYGAKISNFAFQHGIAGASEGIYVGDGSRADNLYNCDIDMMGWWEGGGNSTALYVADKARVDGFANFRYDGFAASAMTSSSQPCRLVRKAGLTGYVKLNCRNYKHEAGLGLTAGVTQLTIRPWLAIAEAAAGVATPHPTLPGESIVSVPGMKCKLVGTLFKGQNSVISVVGMPPFHRYKVTTRCGLSSTAQQQYIVNIPNGANGGITTRTDSVPAVTTDTDTIINGTTAESTSTSTAKNKNFEPVYISNAGSLADNTFSNTNKQGFDIHLDGTQSNVVNDEYPVSIEIEAID

SEQ ID NO: 37 - DNA, 2376 bp, Artificial sequence
  specific to K30/K69
atggaccaagacattaaaacagtcatccagtacccagtaggggccactgagttcgacatcccgttcgactacctgtcccgtaagtttgtccgtgtgtcgctggtgtcagacgacaaccgcagactgctgagcaacatcactgagtaccgctacgtgtctaagaccagagtgaagctccttgtggacacgaccgggttcgaccgtgtggaaatccgacggttcacctcagcgtctgagcgtatcgtggacttcagcgatggctctgtactacgagctgccgaccttaacgtttctcagattcaatcggcgcatatcgcagaggaagcacgcgacgctgcccttatggccatgcctcaggatgacgctggtaacctcgatgctcgaaatcgtagaatcgtacggttggctccgggtatcgacggtacggacgcaatcaacaagaaccagcttgatacaacgcttggtgaggctggtggtatcctgtcagagatcaaaggtgaaaaggagcagttctacgagtaccttgagaaattcgcagacgataccacgatgattcgcggagtgacatgggtctacaacggaggctcggcggttggcggtgagacgtctatcgtaatcaataaaccgacagctgtgtttgccgtgccgtacattgagataaacggtgacagtcaagaggtgggctatcagtacgacttcaacgccagtacccagacaatcactttagcgaagcctttggcggctggagacttcttgatggcaatgacatccgagtcccaccttccgttagaatcccttcttgctgggaccacaggcgcatcctcgattggtaccaaagatggtggcactgttcaatctgcgctggataaccttgggtactacattgtgccagagtcgtttggggcgaagggcgatggggttaccgatgataccgcagcagtccaagcggcgataaacgcagctaaaggtaagaccctatggctcgatgcttccaagatgtacatctgccagaacttggtaatacctcatgcgatgaccattgcggctggaggtcgtcggcagggtggcggcctaatccctaaaggtaactcaggtcctgtagtacactccggggacttcattctgattaccgcagagcagaccgtgacaatgttcaacgttacgattgatgcgcgtggtcgccctctgactaaggtagatgggcagcgcctgaacggtctccgacaggtcgacaacacttctggcgtctatcggtctggtttccaactatataactgcaacatctctgggttctctgggcttaatattgttggaggtgcagcacgctcttttggtatcatcaaagacactcagtgtgaatcttcggacctgacctgtatccgtatccaaggtgttgactggcgaatcgaccacacctacgttggccgtagcgggacagggcacggcattgagttacttaatgagtcaaacgttgtgtctaactgtgattcctacttcaacaagaagtctggtgtcgtgtacacgcaggcaaccgggaagactttctttaagctcatcgcctgtacactgaactctaacggagaacatggcgtctacattgcgtgtccgtacatgcagcctgctggtatcatcattgttgataaccgcttctggaacaactcaacgtcttcagacggagtctatagcaacatcacgcttagctacggtcgagggcacattgttgttggtaacatccacgaggcataccaaccagcggacggcagcagctcagcaagggcagcttactgtgttaacctactgaacggtgcccgtccggcccacatgctcgacaactatgacccggcgtattcctatcggaccgacttctgcaacattaacgtcgtcgataagattaactacaatacccaccacattggtagcgccaagacgttcaccgtgggtgtctcgtcagccacctcgcaggctattggcgtatttgttgacggggagtcgttcccaagagcgtccattggtaacggtggaatcaggttcggtaagggtgacgctgcaccagctgtaggacttggcttcgacaacaactatccgaaccacgtggtgtcgttcaagggccttgctgttctcggggcttgggacaccagtacattcagggtcggcgggtatcgaatctgggcaggcaacggggcaggtcagctgtacttccagtatggtgcggaccctacgagccagacggacggcaaactgttcgttgggcgcactgtgtcgccaccagcttcttcttcatcttctggtaacacaggggatatcgccatcgactcagggttcctttatgtgtgcgtagcgttcaacacatggaaacgggttgcactttctacgttc

SEQ ID NO: 38 - protein, 792 aa, Artificial sequence
  specific to K30/K69
MDQDIKTVIQYPVGATEFDIPFDYLSRKFVRVSLVSDDNRRLLSNITEYRYVSKTRVKLLVDTTGFDRVEIRRFTSASERIVDFSDGSVLRAADLNVSQIQSAHIAEEARDAALMAMPQDDAGNLDARNRRIVRLAPGIDGTDAINKNQLDTTLGEAGGILSEIKGEKEQFYEYLEKFADDTTMIRGVTWVYNGGSAVGGETSIVINKPTAVFAVPYIEINGDSQEVGYQYDFNASTQTITLAKPLAAGDFLMAMTSESHLPLESLLAGTTGASSIGTKDGGTVQSALDNLGYYIVPESFGAKGDGVTDDTAAVQAAINAAKGKTLWLDASKMYICQNLVIPHAMTIAAGGRRQGGGLIPKGNSGPVVHSGDFILITAEQTVTMFNVTIDARGRPLTKVDGQRLNGLRQVDNTSGVYRSGFQLYNCNISGFSGLNIVGGAARSFGIIKDTQCESSDLTCIRIQGVDWRIDHTYVGRSGTGHGIELLNESNVVSNCDSYFNKKSGVVYTQATGKTFFKLIACTLNSNGEHGVYIACPYMQPAGIIIVDNRFWNNSTSSDGVYSNITLSYGRGHIVVGNIHEAYQPADGSSSARAAYCVNLLNGARPAHMLDNYDPAYSYRTDFCNINVVDKINYNTHHIGSAKTFTVGVSSATSQAIGVFVDGESFPRASIGNGGIRFGKGDAAPAVGLGFDNNYPNHVVSFKGLAVLGAWDTSTFRVGGYRIWAGNGAGQLYFQYGADPTSQTDGKLFVGRTVSPPASSSSSGNTGDIAIDSGFLYVCVAFNTWKRVALSTF

SEQ ID NO: 39 - DNA, 2178 bp, Artificial sequence
  specific to K31
atgatgacgactccaactaagaacgacattccaagcaataatttgttggatgctcgttttaactttgaaaagctcgatcagattgttaatagcgacgcgaactattaccttgatcgttttggtaaacaaagattaactgcggttggtcttcagagtttaattaaccaaataggtagtgatttcgagaacaatatcggcctcccagatggttttcgttatatcggtaaggtatcgtcgttcaatgccttgagaactctgagtccggtagtcgatggccagaaaataatactgaatggttggaccgaagggtcctcattaggtggtggtgaatttgttggtagatttggtgtaggaattgatgacggtaagtcgaccgctgctggcgatgggttttactgggagagagttgatttaccgtttataagtaccaaaactaattcttctatcagcagaacattacaaaataaattgcgggaaatgccttcgatttttgactgggattccgatagcgccaatgatgacaccactagatttacaaaagcacttaactcaaatgtggataatattttcatacctagcaccactgaaataggtagtttgaaaatagcaaatgtcgatgtgaccagaaacgttcgtttctgggggacagctatagccgggtatcggcaggtcggagcgtcattggtagttttggatggggctagttatgggttcaaattctcgggtagtggaaacggctccgccgctaacacactaagactcattggcggcgggatgacaggagtttcgttaataggagagtcttctaacaacactgctgattttattatcgttaaccatgcatcgagtttggaattttcaaacgtctcattaagacgatccgccggggcgggctttgtactccaagatttcatggaaagccgaataacagattgttatttcaatagtgtgggtggggaaactaaaaatgtcatccacattggtgattacatggatagtctaccatggaacgtcaataatcttcacatcgagagaaacacatttggttcttgtggcgggtatttgatatttgcctctgagaactccaacgctgatctgatctggattaaaaataataaatttgaatgggatagtgaacctttaaaccccaacgttacggataagtctgttatttatttgggtaaagtggaaagggtttatgtggacgataatgggtttgtctattattatccggcacacagtaactattccacgattttagaacttagtcagaatgctcgatacggcgttcaattcaaaggcaacagtgcttgggggtgcactaatgctaattactggaaggtttctgggggatctttactcgccaccaataaccgtagtaacgcgccgatgtcaaccatagtcaccagtgcctatagtcaagacatcgatcctcctctgatacgaacctctactggaaacaggcccacttcctataatccgaagtcgtcatattctgattttgtttccgcacatgatttaacgggggctaatgacagtaataactttgtggctgactccgacgcattattgaacggaacttcgcagcaagctgcggtagggcaggaaataaggcgtttgttaataccaaaagatctaatggtatcgggtagggttctgaaggtttccgcgcgggtgaaaaacaccgacagcacgattggcggtaacattcagcttcttcttgacggagcgatagtcaataacaacactcactcgttagttacatcttccaactttttaactatccctgtgggtggggggtgggtgcaacttgattggtatatcacacccactatgataggaagcggtgctggctccctaatattcaagaatacggggactaccacttttctttttgatggcgtgagtatcaaatatgccgattatttcgacctcactatcccttggacgccggggaccgttcctgcggccactttggtcaacaccactgtcacgagtacgagattttccgcttttgttaccggggttagtggattgagaacggatcagggtttgggaggagctttttcttcagcatattttaatgcaacttcaaatcaattagtgcttcaacttaggactttcgaaagtcaggccgcggtagccgccacatctttcaagattaggttatttttaaaa

SEQ ID NO: 40 - protein, 726 aa, Artificial sequence
  specific to K31
MMTTPTKNDIPSNNLLDARFNFEKLDQIVNSDANYYLDRFGKQRLTAVGLQSLINQIGSDFENNIGLPDGFRYIGKVSSFNALRTLSPVVDGQKIILNGWTEGSSLGGGEFVGRFGVGIDDGKSTAAGDGFYWERVDLPFISTKTNSSISRTLQNKLREMPSIFDWDSDSANDDTTRFTKALNSNVDNIFIPSTTEIGSLKIANVDVTRNVRFWGTAIAGYRQVGASLVVLDGASYGFKFSGSGNGSAANTLRLIGGGMTGVSLIGESSNNTADFIIVNHASSLEFSNVSLRRSAGAGFVLQDFMESRITDCYFNSVGGETKNVIHIGDYMDSLPWNVNNLHIERNTFGSCGGYLIFASENSNADLIWIKNNKFEWDSEPLNPNVTDKSVIYLGKVERVYVDDNGFVYYYPAHSNYSTILELSQNARYGVQFKGNSAWGCTNANYWKVSGGSLLATNNRSNAPMSTIVTSAYSQDIDPPLIRTSTGNRPTSYNPKSSYSDFVSAHDLTGANDSNNFVADSDALLNGTSQQAAVGQEIRRLLIPKDLMVSGRVLKVSARVKNTDSTIGGNIQLLLDGAIVNNNTHSLVTSSNFLTIPVGGGWVQLDWYITPTMIGSGAGSLIFKNTGTTTFLFDGVSIKYADYFDLTIPWTPGTVPAATLVNTTVTSTRFSAFVTGVSGLRTDQGLGGAFSSAYFNATSNQLVLQLRTFESQAAVAATSFKIRLFLK

SEQ ID NO: 41 - DNA, 2157 bp, Artificial sequence
  specific to K33
atgccagatattattgaaacagggagatggagcgagaagataccgcttatttcccgcagcgacagggttgagggtggccggtcgggactggttaatattcagactgaaattctggctgaccgcactcaatatctgagaaagcagctggatgagacgaacggattattaaaatcaggcgaactccctttttcaggcgaagctgatgcggtcgctgcaatcgccgccgggaaaattccggaaggggcgttattctcaatccgttctgacgatcctgctgtatgggtggaagaataccggaaccagagcggggagccggtttccacgggtaaaaaaattctgagcagtaaagccgttacgttaaccgtattcccgacggatgcggatccggatggcaccattgcgggtattgatgccacgaccaccggacaggcattcgtggttatcagggataacaaagagtttttatatcggaacgataatggcactgcactgagtatcagtgagtcggtgagcactgacgaatttgacgccgtcaaagatgccatgcagaaaatattactgtcctgccacattatcgcggaagcattgggcgggctggatggtgacagtcagtctgtccgcgacgcggtcctgaatctgcatgtctcgcagcaggtgctttcgtgcgccgtgaatgagctggggggattgccggaggcggtgcaggggctgcaactgaatgcgttgatggcagtttccacgctgggcagcgcgttgacaccgctggaagggttcgaacctggcagcagtgacgatggcgattatgacacttcgcaacgcctgcttaataatctttataacctgtccatgctggccggggcactggtgccgctggacggtttcgatcctgatgcgatttctgttgaggcccgcgaaacgtacagcgagcagtacacgtttccgaagccgggcaatattattaaattatttgtcacgtcgccgtcaggtattccggcctctaaaggcgcgggtgaatattataccaccgctacgattgatattgatggtgaaatactgaatatcccgtattcatctatttccgtgcagggggattcgtccgcagcctacgcgaaaaaaaatctcaatatcgggttatatattgacgacaaatacgatgatttatttacgctaaaaattggcgactgcctgccgcacgatgaatgggtgtttaaggccaactggattgaccacacaaacctacgcaacctgatgagttatcatctgtgggaacgaatgatggcatcccgcgacggctggccgaaacgagatatcgataattattacgtcggtaaaaccggactggatgaaatggatacgcgggcaacgggataccctgtcggctatccctgcgtcatgtatatcaatggtgatttctacggcaccggcgcgctggctatcggcaaaaagaaagaaaattataatattccgaaaaataaagccgaacagataatgattatcatggggggatggaagtccatcacgaccatgtacgataacgctcaggttaccgatacggataccatagaaatcaaagcgccgaaaactgtttcagaggagacgctgggctatctgcaggactgggacgcctttgcgaacctggcacaagccgattttacggaacaggcaccggcgcatctcgatacccgcaatattgttgatttttatttgttgctggccgccatcggtgcgacagacctctttgccggtgataaggccaaaaacgcgattttttatacctgggacgggacaaagtggtatttcgggccgtatgacctcgatactacttacgggttgcattacaacggcacgcagattagttatgccgctgattcagcaccgaaaaccgacggcggtacgttctggaaaaaaatactggtcacgtatgctgacgagctggccgcccgttacgccgaactccgcgataaagatattttcagcgtgaattgcctctatgacattgccgccggactgtccgcgaaatatacccacgaactggataaagcggaaatcaataaatggccgactaaaccgtcgctaaccgtcacgagtcgcgatcagatattcagctggtttaacgaccgtctggcgtatctcgacaataaatttaattacacccga

SEQ ID NO: 42 - protein, 719 aa, Artificial sequence
  specific to K33
MPDIIETGRWSEKIPLISRSDRVEGGRSGLVNIQTEILADRTQYLRKQLDETNGLLKSGELPFSGEADAVAAIAAGKIPEGALFSIRSDDPAVWVEEYRNQSGEPVSTGKKILSSKAVTLTVFPTDADPDGTIAGIDATTTGQAFVVIRDNKEFLYRNDNGTALSISESVSTDEFDAVKDAMQKILLSCHIIAEALGGLDGDSQSVRDAVLNLHVSQQVLSCAVNELGGLPEAVQGLQLNALMAVSTLGSALTPLEGFEPGSSDDGDYDTSQRLLNNLYNLSMLAGALVPLDGFDPDAISVEARETYSEQYTFPKPGNIIKLFVTSPSGIPASKGAGEYYTTATIDIDGEILNIPYSSISVQGDSSAAYAKKNLNIGLYIDDKYDDLFTLKIGDCLPHDEWVFKANWIDHTNLRNLMSYHLWERMMASRDGWPKRDIDNYYVGKTGLDEMDTRATGYPVGYPCVMYINGDFYGTGALAIGKKKENYNIPKNKAEQIMIIMGGWKSITTMYDNAQVTDTDTIEIKAPKTVSEETLGYLQDWDAFANLAQADFTEQAPAHLDTRNIVDFYLLLAAIGATDLFAGDKAKNAIFYTWDGTKWYFGPYDLDTTYGLHYNGTQISYAADSAPKTDGGTFWKKILVTYADELAARYAELRDKDIFSVNCLYDIAAGLSAKYTHELDKAEINKWPTKPSLTVTSRDQIFSWFNDRLAYLDNKFNYTR

SEQ ID NO: 43 - DNA, 2406 bp, Artificial sequence
  specific to K34
atggaccaagaaattaaaacagtcatccagtacccagtgggggcaactgagttcgacatcccgttcgactacctgtcccgtaagtttgtccgtgtgtcgctggtgtcagacgacaaccgcagactactgagtaacatcactgagtaccgctacgtgtctaagaccagagtgaagctcctcgtggagaccactgggttcgaccgtgtggaaatccgcaggttcacctcagcgtctgagcgaatcgttgacttcagtgatggctcggttctccgtgcaacagaccttaacgtttctcagttacagtctgcacacatcgctgaggaagcacgcgacgctgccctgatggctatgcctcaggatgatgcaggtaacctcgatgcccgtaaccgtcgaatcgtccggttggctccgggtattgacggcacagatgctatcaataagaaccagctggataccactctaggtgaggctggcggaatcctatcggacatgaaggacctagagtgggagattcacgactacatcgagaagtttgcagacgacacgtcggttgtgcgtggggtggcgtgggtgtataacttagggtctgcaaacggtggtgagaacgttattaccattgataagcctacccgcacgtacgctgtgccgtacattgaggttaacggctcgcgtcaggaggtgggataccactaccagttcgatcttaatactcagagcatctccctagttaaaccccttgagaagggtgacttcttaatggccatgaccacggagtcgagcgttcctctggaatccatgttggcatcggctgcgggtgcaagctccgtgggcaaacttggcggtggtactgttcaggacttcatcaccaacactgagtcaaaaattgacagctttagtgttcttgaggactttgggccagttggtacacctgaggatactgctgcaactttactttcatcactttcatccggtaaaccaatagtgttgaccagaatgtattcgcttcctatgcgtacatttagtctaccgagtggaactacgctgataggactaggggcgaaaactggcttcaaggcggcaggaggtactgaactattcgtcaatctactggaggtaggcgggaccgatgtgctactctccaacttcgcaatcactatggatgcggcagggcgaggatccgtgggaagcgttgcgtgctatggggtacacttcctcgccagctctcgcggtaaccgtgcccaaggacttaagattactggcaaggccgtagggtctacagtagggttcactcacggggttcgctgtaatggtgttcgtaacgttgtggacaagtgcgatatacagtattgctcaatggggataacccttcggggcgagtaccataagattacgaacaactaccttaacaaccactatgtggacgagaaccttgggtcttggacgtctgcgagtatgttctgggacggaatcactggtgaaggttgcatcaactgcgagattagtggaaacatctcagagtacaatgggcagtctggaatctactttggtggtaacaatagccttagtcaaggtttaatcatcaccaataatatatgccgctacaactacaaccgtgggtgtgacaccggaatctctgggacagcttctgacacaaacaacgtgatagacgtaacgtactcgagtaatattctcgagaacaacagggagacaaacctgtggctcttcggtgtaagcgagtcaacgctgattggtaaccacatccgggagacagccctgtatgacacactgttccctaaccaagctagtactacccgagcaggacttgcacttggcggactgacgtgtaacaacaatgagatagtagggaacaacatccgtgtgcgctctacgacaccatttggaatcgtacttaacggtaccgggcattacctggcagccaaccgcaggattggtggtgcgtccaactacatcttcgctagtgataaccagcgtttggtgggtaactctattgagcgatatacagggtcattcactccaactttggtgggcacagctggcataaacgtcacatctgccacaggtcgctatgagattcaacgtaacgtactaacggtggaaatcaacatgacgctgtccgcaaatggtgctacaggtgctatcgccatagggtacatcccgggtctgtcttcggtcacaccagtaatgcgtgacattaaagttacactgcttaatgggtggcttccagctctgggcgataagaccatactggctcgtgagggtactagtaatgacttgttgaacctcgtagtgttttcctatggtaaccagtctaacgaggtggctcagtatgttggcccagcgtcgtccctgagaattaccgccacattcaacacctcagctacctta

SEQ ID NO: 44 - protein, 802 aa, Artificial sequence
  specific to K34
MDQEIKTVIQYPVGATEFDIPFDYLSRKFVRVSLVSDDNRRLLSNITEYRYVSKTRVKLLVETTGFDRVEIRRFTSASERIVDFSDGSVLRATDLNVSQLQSAHIAEEARDAALMAMPQDDAGNLDARNRRIVRLAPGIDGTDAINKNQLDTTLGEAGGILSDMKDLEWEIHDYIEKFADDTSVVRGVAWVYNLGSANGGENVITIDKPTRTYAVPYIEVNGSRQEVGYHYQFDLNTQSISLVKPLEKGDFLMAMTTESSVPLESMLASAAGASSVGKLGGGTVQDFITNTESKIDSFSVLEDFGPVGTPEDTAATLLSSLSSGKPIVLTRMYSLPMRTFSLPSGTTLIGLGAKTGFKAAGGTELFVNLLEVGGTDVLLSNFAITMDAAGRGSVGSVACYGVHFLASSRGNRAQGLKITGKAVGSTVGFTHGVRCNGVRNVVDKCDIQYCSMGITLRGEYHKITNNYLNNHYVDENLGSWTSASMFWDGITGEGCINCEISGNISEYNGQSGIYFGGNNSLSQGLIITNNICRYNYNRGCDTGISGTASDTNNVIDVTYSSNILENNRETNLWLFGVSESTLIGNHIRETALYDTLFPNQASTTRAGLALGGLTCNNNEIVGNNIRVRSTTPFGIVLNGTGHYLAANRRIGGASNYIFASDNQRLVGNSIERYTGSFTPTLVGTAGINVTSATGRYEIQRNVLTVEINMTLSANGATGAIAIGYIPGLSSVTPVMRDIKVTLLNGWLPALGDKTILAREGTSNDLLNLVVFSYGNQSNEVAQYVGPASSLRITATFNTSATL

SEQ ID NO: 45 - DNA, 2133 bp, Artificial sequence
  specific to K35
atgggtttaactcgtttaaccgacaagcttgtaaagtttgtgcggaataaacttcggacctcctttgcagcgaactcggtacatgctggtgtgcagttgatgaataccagctgggtttctgtatatgagttccaggacaagattacggacaagccagacccaggagatgcacagacctgggattgggcacccgcattcaatgcggcagttacctatcttatgagctatgacacagtcgtgctggcaggtaacactcacggccttgagcgcgcactcttcgtcccaggtggtctgtataagaccaagtccaccatcgttatcgacaggtacatggcgagcaacggcaccttcgcatccaccttcaagcttgttggtgaatcaaggacctccagcgtaatccaaccaatggagtctggacaggtgggtatccgtgctcagcgtattgcattggacctggagggtgttggcttccgtgcaggtgcatcctatcagacaggggctgtgctgggcaatgagacagaatggcaaccttgtgcgcactgcacctggaaggacgtaggattctccgggttctctgagggtgtactcgcatggctattatttgactcaacattcatcgacctgttcatccagaacatcacagccaagttcgatgggtcaacgtctaccgggtttaacttcggcctgtacaagggtccgcagaatggtggtgtgtggcaggatggctctggtgatgtatctaacaacattaccttcattcgcccgaccatcgagacaagtagcgacacgattcctactgtcttctttaaaggagaaggtcgtaaccagtcatactccgtccataacgtcaacgttatcggtggtcacgtagagacacacaatcgtctctccaaggttgtatctggcatctactgctatcactggaacttctacagtacggtgcttagtcagaatggcagcgaggttattgacccaacagagttgatgtacctcgaaaactgctttaacatctcgttcaaccaagtgcgtatattgcagaacaacaaggtggctgcttacaacgaaaaccttccgaagatgattcgtatggttgggaacacaagtgacatccactttaaccagtgctacttctccaccccattcgccaacatcaatggttatcatggtctggagtatgttatcgactacagtgctgctgcgcttcgtactcgtgcattcacggacaacggttgtaagtttgactccttccagcgtgctggcggtacaagcaagcaaaccctggttgaccggtttaacggcgataagcgctggactcagtatgtcacacaggatggacgcttcatgctgtcttactctgtggatgcatctgggaccactgcccccaccgacctgatttatggtaactcatctggtgattggtttgcaacaaggtatctccaggcaggtaaccgtgtaataattggctctggcactgacaccacaaccaagggtatctcttggcaatttagcgctaccaacgtagcccttattgacgtggactcggtcggtcgcatctaccttaaaccagttgttgcaacaggcaaccagtggtctgttggtagtactcagattctacctagcgtaactgcaacaatggagattggctctgccacgtataccgtgaagaacatcaccttgcagaacgcccctgtggttatctcagatatcaacagaaagactgttgtgtctaaggtgagtgaagatgatgcattgatgcaggcatggggcactcttgacttctatctcttctacatgaaagaggcacaaagaagcaagggtgagtttgcccgtaagcatgctggccttatcgcccaggatgtgcgagatgcactggtgggtgctgggctaagcatcgacgactactcctttattggtctgtcagaggagcggtgggaagtcgaagagattgacggcaagtacaagccaactggctctgacacctttggcctctctctggatgatgatggttatatcatcccggatgaagatgtcgatgtgtttgaggatggacagctcatccgcaaggtctaccacctccgcatggaggagtgcctggctgtagagatggcatatcagcgttggctgaaacagcag

SEQ ID NO: 46 - protein, 711 aa, Artificial sequence
  specific to K35
MGLTRLTDKLVKFVRNKLRTSFAANSVHAGVQLMNTSWVSVYEFQDKITDKPDPGDAQTWDWAPAFNAAVTYLMSYDTVVLAGNTHGLERALFVPGGLYKTKSTIVIDRYMASNGTFASTFKLVGESRTSSVIQPMESGQVGIRAQRIALDLEGVGFRAGASYQTGAVLGNETEWQPCAHCTWKDVGFSGFSEGVLAWLLFDSTFIDLFIQNITAKFDGSTSTGFNFGLYKGPQNGGVWQDGSGDVSNNITFIRPTIETSSDTIPTVFFKGEGRNQSYSVHNVNVIGGHVETHNRLSKVVSGIYCYHWNFYSTVLSQNGSEVIDPTELMYLENCFNISFNQVRILQNNKVAAYNENLPKMIRMVGNTSDIHFNQCYFSTPFANINGYHGLEYVIDYSAAALRTRAFTDNGCKFDSFQRAGGTSKQTLVDRFNGDKRWTQYVTQDGRFMLSYSVDASGTTAPTDLIYGNSSGDWFATRYLQAGNRVIIGSGTDTTTKGISWQFSATNVALIDVDSVGRIYLKPVVATGNQWSVGSTQILPSVTATMEIGSATYTVKNITLQNAPVVISDINRKTVVSKVSEDDALMQAWGTLDFYLFYMKEAQRSKGEFARKHAGLIAQDVRDALVGAGLSIDDYSFIGLSEERWEVEEIDGKYKPTGSDTFGLSLDDDGYIIPDEDVDVFEDGQLIRKVYHLRMEECLAVEMAYQRWLKQQ

SEQ ID NO: 47 - DNA, 1983 bp, Artificial sequence
  specific to K36
atgacgactccaacacaaaatggtatacccagtagcaccgctatagatgttaggtttaacgccgagaagttagatgagatcattaattctgataatgaaacctacagtgaccgatttggaaacagtaggtttaccattaaaggagtcgtgacctatattcaaaatattttacttgcgttgagcggtaaaacgggcgatgcatccattgggactcccgacagagtcagtgatttaaaaacactttcagtggcggcaaactcgatgttgcgagttaagggttattctgatccttatgatggaggaagcggaacatggtattacgactcttctgaccaaaccgctaatgtgtcggcgtacccaaatttatttatcgcgcctagttcggatctgaccggttcctctggctgttggagattagttactcaggacgctatccctgcggtatcttacggagtaggcgtcagtaaagatcctaattttaacaaatcggttttagagcaaatagtggcctataataaaggttatcgaactgtttctctgccggccagaaccattgtttgtagatcgttagtatttaattatgatccaaatttcttaggaagctttggtgctatcgcttcggtcaatggcggattgggtacggcatttttattctccgataaggatgtcgatggaacaacagcagtaacggaatcctgcattaaggtcgctccttctaatgaaacaactgggcggatgactgggttgtgtatgcgattcattagcattattggtaaagaaggcattaacggattaacaacctttagtacacgtaccggtcgtttagcccttgatctgaattatgttgggggacaggtcgaaatagagaatgtcttcgtagtgggatttactcaaggactctcgcttaatgaagcttgggacggtagcttaactcgatgtcgtgtcattgggtgtggttctcctgacggcgtcacccccgcagtttggatgggatctaaacgcaccgacaataccaacgctatgaaattctggggtttacatgtcgaacactgtccgttcatgatgcaacttgactttgttcgtcatactgaattctacggatgtaagtttgaatctcttcgtcctgtggatacaaccagtaactctattctgattaatgctgcgtctcaagaggtcttgtttagcggcactatgtttgtaactaccgctcaaacactcacccactatatgcaggataaaggtcaaaacaccaaattcgtcggctgtactttcgattcaactgggatatcttcctcgatgaaataccctgggataaggtggtacaagggggtgttgtcgacatcatcgagatcaaactcgctcatcgggtgcaaattcacaagagtcttgccttgtgacggttcggtgtctgacgatcatccgattatccttgccgacggcgatagctttaaaggcgaggtttttgttgacaacacagttactccgtcatcgggtcaggttaatatcgttaacagcgggattatttcattagggaataatagttccgtggaagatctctacttatctgccaacacaaatactaaaacggcgggccccgtgttctatttcaggggcagcggtgctattgttaaaagtctcagaacaaaaccgggaaaccctatattctccgtagctggtggtgattctgcgaattggtttaacaacacggttgagaatgttaatgctaaatgggcgagttctagcgcctcggcaataaatgtagttggaaaaaccacggtgtttttttctagtgccgtgaccgtgacaagtttgattgggacagttggacaagaagttaatctcgtttcatacgtttctggatcaacaataacgtataatgcgagcacattaataaccaattcaaaagccaatatatctatggccgccaataccgcttataaatttgtttgtcgtggtaacgggcagtggactcaggtatcggct

SEQ ID NO: 48 - protein, 661 aa, Artificial sequence
  specific to K36
MTTPTQNGIPSSTAIDVRFNAEKLDEIINSDNETYSDRFGNSRFTIKGVVTYIQNILLALSGKTGDASIGTPDRVSDLKTLSVAANSMLRVKGYSDPYDGGSGTWYYDSSDQTANVSAYPNLFIAPSSDLTGSSGCWRLVTQDAIPAVSYGVGVSKDPNFNKSVLEQIVAYNKGYRTVSLPARTIVCRSLVFNYDPNFLGSFGAIASVNGGLGTAFLFSDKDVDGTTAVTESCIKVAPSNETTGRMTGLCMRFISIIGKEGINGLTTFSTRTGRLALDLNYVGGQVEIENVFVVGFTQGLSLNEAWDGSLTRCRVIGCGSPDGVTPAVWMGSKRTDNTNAMKFWGLHVEHCPFMMQLDFVRHTEFYGCKFESLRPVDTTSNSILINAASQEVLFSGTMFVTTAQTLTHYMQDKGQNTKFVGCTFDSTGISSSMKYPGIRWYKGVLSTSSRSNSLIGCKFTRVLPCDGSVSDDHPIILADGDSFKGEVFVDNTVTPSSGQVNIVNSGIISLGNNSSVEDLYLSANTNTKTAGPVFYFRGSGAIVKSLRTKPGNPIFSVAGGDSANWFNNTVENVNAKWASSSASAINVVGKTTVFFSSAVTVTSLIGTVGQEVNLVSYVSGSTITYNASTLITNSKANISMAANTAYKFVCRGNGQWTQVSA

SEQ ID NO: 49 - DNA, 3501 bp, Artificial sequence
  specific to K38
atgaataagatgtttacccagccttctggcccggtagcaaaagagacgaataaagaggctattgcaagggtgcatggccttagaaagtcacaggttgggtatattaccaatactactcccatcgactcgtatacggtactgtttgacaaaaccactcagaccacctggtttcgtgggcaagctacaggcactcctgtgtcttggtctattgctggagatgccttaaatttggtaaccaatgcaggtacctttaccttagccccatctaataactttaccgtaaacgctacagtagatattaaggctttacgtataacccctcatgaaatcaaaaccaatggcttttatactaagaatgacggtggtgatgctgtatgggtagctacaggtaataccaatgcctctcttgctggtaagcacgtgatacaggaggctaagatttataatgctaatggttctgagtaccaactgcgagttggtaaaggtatgggtattattagccccatagctaatggtgccaaagaggttgcaaactatgcagaagcccaagccgatacagatgactttgtttgcctgggtcaagccattaacgggataatcaaagttatccctctatggttgcagcctggtaacaacgttaatgaccagagtacttactctgtcattacgttcaatatttcttctggtatttggcgtatcggtaaagaagctgcgaagttgcgttcgaatgttatctataacctcggtgcatctacgatttatgttaaggcaagtgcttctcgtaaattccaggtgactggtaaataccttaacgggttcgagcattccgtagaagatgtggaagaggtatatgcagcgctcggaaaccagctctattgggagtcggtaagtctaggctttgttacgttcactggtggtaaaatcatcggcgaccatgttcccggtacgctggatgctgactgtactgccggtgtcggtatcctggcacttaacccatggtactgctcttttgaagacagccgcgtagagaacttccgtgtcaacctcgtcgggatgcaggttcgcattgatgaggatggtgtgatgtctagtgatatcatcccatacaaatctagtgccctccctgagaagattggtaacttctacgggtgtacattcaaaaatctatatatcagtacagcccgttactgctgtgttcgattgcacatcgactggtgtcagtggattggcgggactatttccaacaacggacgctggacgttttcggtaagtgggcagcagtgtgactactatttaatcgaaactggtcatggcttccattgctcaggtgcatatctcagtatcccggcgtacaacccgaccgaacgcaaaccgaacaagtctgttatcgcaacagctgcccgtggctctgtctacactgcgtgctacatggaagacactccttcctacgtcaccatcctgaacaagtggtggaacgatggcaacgagaagggcttcggtttaaatatcgactgcatcggttcgcagtaccgtcctgaccgaacctataaatacctgactttcgagccaggtgcatttgggtattatgatgctaatgagaactgggtgccgccagccggatatggttcgtacccgtcaaccaacggcattgactttgttcgcttcggtagtccgacacatgatattggtgcattcccacacggtggatttgacttcaaatacggcacctatggtgttatgtacaacacaaacaccacttacccaaatccaccagatgtggatagtatgcgcgggcacaaaactaccaaggagatgttctctccgtatgggctgatggcggcgaatggtatcctgcaactgccggtactgtcacctgcgatgcacagcaatatctgtatctggtacaaagacctgaccggaagttttgacctgtccaacatcgctatctggactaatgccaacattgaccagaattccacggatgccgggtacaaccagaacctgttctttgctcgcgcagagatggcggttgactatggtaatggttataaaatggcaattatccagaacctgaagtggaacaacaatgatggcgttggtacagcgggtagtcagcagtcgttgcagtttactatacctgacaccactcccattgttctcaaggccgttcaggcgttcactggtggtattccggtattccctgtcgggctggattatcgtcctgagacgtcagatttatgtgtgtggggtcacgtcaatccgagtaacggatttaagtacaacctgtttaaaaaggttggcggcggtatcttcatgccggaggatgttatctatccgtggacggcacatcaacgtgctaacacagattacaagtttgccactactgtttacgaggattatggttttacgaatctgccgttaatcatcaaaggtggtaatagtattggtgccttcttcgctaaggagtttaccgtaactgttgttgaggttgactccactaatagccggacaaccgtagacgtaccagctgcgtataagccatacgtttttatgggggttcctcttaatattaccggaggttcgtccactggatatactggtgaaacccgtatccataagcgtaacctaaaaactgatggaacccttagcgggcagtacgtccttgatgcggttgttggtgccgttggtgatactctgaacattaaccagagaacactcacagcacgtacttatcgtcgtgactataccgcagacgctctaacagcaaacggcagctttacccttcgtggttctacaatgcgattcgggtataacgctggctcaacaagcacgcgagcaattgagttttatgtcggtggagctaccactaagtccgctgatataaacgcatacggaacctcacttggccttaatgcctcggctgttgtctttggtggtaacattggcttcagtgcaacaaacacctgggacattggctcccctggtaatacggtcaaaaacatctacgcccagaatgcggtaactgttgtttcagaccgtgaccgtaagcctgtacgggaagggataccagataagattcttgatatctggggaacaatcggcatcaagcggttcaagtatgactgggctattgctggaaaaggtgaagatagcgcacgctggcatgttggttacattgctcaggatattattgaagcattcgaagccgcaggggaagacgctaccgaatgggcgttgcttgtacgcaatgagtgggatgcccagccagaagaggtggagtcatgggacgatgagtacgaaattattccggcgcagtacgatgagcagggacagaaggtgtccgaggaaactaaggttttggtacgacaagcaggttcccgtgttaccaaagaagcgataccagcaggaggcgagtggcggcttgttatggatgagtgcaacgcaatggaggatgcgtatcaacgcagacgactggataggttagaggccgcagttaataag

SEQ ID NO: 50 - protein, 1167 aa, Artificial sequence
  specific to K38
MNKMFTQPSGPVAKETNKEAIARVHGLRKSQVGYITNTTPIDSYTVLFDKTTQTTWFRGQATGTPVSWSIAGDALNLVTNAGTFTLAPSNNFTVNATVDIKALRITPHEIKTNGFYTKNDGGDAVWVATGNTNASLAGKHVIQEAKIYNANGSEYQLRVGKGMGIISPIANGAKEVANYAEAQADTDDFVCLGQAINGIIKVIPLWLQPGNNVNDQSTYSVITFNISSGIWRIGKEAAKLRSNVIYNLGASTIYVKASASRKFQVTGKYLNGFEHSVEDVEEVYAALGNQLYWESVSLGFVTFTGGKIIGDHVPGTLDADCTAGVGILALNPWYCSFEDSRVENFRVNLVGMQVRIDEDGVMSSDIIPYKSSALPEKIGNFYGCTFKNLYISTARYCCVRLHIDWCQWIGGTISNNGRWTFSVSGQQCDYYLIETGHGFHCSGAYLSIPAYNPTERKPNKSVIATAARGSVYTACYMEDTPSYVTILNKWWNDGNEKGFGLNIDCIGSQYRPDRTYKYLTFEPGAFGYYDANENWVPPAGYGSYPSTNGIDFVRFGSPTHDIGAFPHGGFDFKYGTYGVMYNTNTTYPNPPDVDSMRGHKTTKEMFSPYGLMAANGILQLPVLSPAMHSNICIWYKDLTGSFDLSNIAIWTNANIDQNSTDAGYNQNLFFARAEMAVDYGNGYKMAIIQNLKWNNNDGVGTAGSQQSLQFTIPDTTPIVLKAVQAFTGGIPVFPVGLDYRPETSDLCVWGHVNPSNGFKYNLFKKVGGGIFMPEDVIYPWTAHQRANTDYKFATTVYEDYGFTNLPLIIKGGNSIGAFFAKEFTVTVVEVDSTNSRTTVDVPAAYKPYVFMGVPLNITGGSSTGYTGETRIHKRNLKTDGTLSGQYVLDAVVGAVGDTLNINQRTLTARTYRRDYTADALTANGSFTLRGSTMRFGYNAGSTSTRAIEFYVGGATTKSADINAYGTSLGLNASAVVFGGNIGFSATNTWDIGSPGNTVKNIYAQNAVTVVSDRDRKPVREGIPDKILDIWGTIGIKRFKYDWAIAGKGEDSARWHVGYIAQDIIEAFEAAGEDATEWALLVRNEWDAQPEEVESWDDEYEIIPAQYDEQGQKVSEETKVLVRQAGSRVTKEAIPAGGEWRLVMDECNAMEDAYQRRRLDRLEAAVNK

SEQ ID NO: 51 - DNA, 2005 bp, Artificial sequence
  specific to K39
atggctttagtaaaacttacgcgggtagcggaatggcttggaacatatatccacagcctaagctccgtgcagcggttgctgggtagtaagttagatgacaccttatgcgttctggatttcggtgccgttgctgactacaataccagtacacaaactggtacagacaacaccgcagcgttccgggccgcgattgatgctgctatatctaaaggtattaggaacgtctacgttcctggcggccagtaccttattactggtgaactcaacctcggaggcactagctttacctccggtgagggtactcgggattactggagaggtattactcaaggtgtgcacctatacggagacgggccgtacagctctatcctagtattcgatgctcaggacgagtatactccgtgtgtatctgcccggggtggttggggcacgcactctccgcgagcactatccggtatcgccatagagcccaaagtgtggatagattacaacagcacagccaaaggtactggtgtcctgttacagggctgctgttttgtaccggtaactgatgtgcacattgggcgattccaccgcgggctgcacttgtggaataagttacagggtcctaacgacaccgccaatacctttacacagggtgactttaccgagtttaaccgcatgactcgtgtacggttctttaactcggacatcgatattgattatcaggttagtttaggcaacaactcgttccacggaaactctttcaccgactgcatggcgcagattaactcctacgggggtattggtatgcgcatgtgggatgatggctcacgaaacgctattcgtccaagttcgatgccttacgagtacattgccaatgtatataacaacaagcacgagattaactggtacggtagtgacgcaagaacctgctatctcatgcacatcgataaggcccaaggtcgtggctgcaacggggacatgactgttgaggctgctgttacgctgcgggtagtgggtcagtactggtaccagagtttcgggagtctgcacagtatttccgccatcaactccgtggtagacggtacgaccgacactgcgacacgtccagtggcgttcatgtggctcaatagcgcgtatccgcaagccaactttgacggtggtgatgcgctgttaagctcttctttgtaccctcggcagtttgacctgaacaactccgggaacactggcatggagttgttgaacattcgaggaaccagtgccggtgctatctggtcaatacagaacggcgcagcactgggctggattctgggaaggcgcgcgcagtctgcgagcagaccgggtacccggagtgtgtggcagttctcctacaacggtgaggtgattaagtcggtagcggccgacaacgtgggcctgcagaaccaaaatggggccggagtaggtatgctcggggacgtactgtttcgtccgtataccgggggtacagtgtctttaggcagccctacttactcctttacgcgcctgcgtactacggattggactattgacaccttcggtattgtaccagtacaggatggcattaagaatgctggttctgctagcaatcggttagggactatctttgctgctaccggtactatcaacacctcggatgcacggctgaaaacggatgtccggcctatgagtgccgctgagattgcagctgctagtgacctcagttcggagattggtttcttccggtgggttgatagtgtagacaataagggagaggactccagggagcattgtggtaccacggtgcagagagccattgagattatgcaggagcacgggttggacccattcaattacgggtttatctgctacgactcctgggatgagcaggtagaactcaatgacgagaccggtgaggtcattagcaccatcccagccggggaccggtacagcttccgcatggaccagttagcgctgttcttggctcgtggcgtggatgctcggctgcaggcactggagggtgcatgag

SEQ ID NO: 52 - protein, 667 aa, Artificial sequence
  specific to K39
MALVKLTRVAEWLGTYIHSLSSVQRLLGSKLDDTLCVLDFGAVADYNTSTQTGTDNTAAFRAAIDAAISKGIRNVYVPGGQYLITGELNLGGTSFTSGEGTRDYWRGITQGVHLYGDGPYSSILVFDAQDEYTPCVSARGGWGTHSPRALSGIAIEPKVWIDYNSTAKGTGVLLQGCCFVPVTDVHIGRFHRGLHLWNKLQGPNDTANTFTQGDFTEFNRMTRVRFFNSDIDIDYQVSLGNNSFHGNSFTDCMAQINSYGGIGMRMWDDGSRNAIRPSSMPYEYIANVYNNKHEINWYGSDARTCYLMHIDKAQGRGCNGDMTVEAAVTLRVVGQYWYQSFGSLHSISAINSVVDGTTDTATRPVAFMWLNSAYPQANFDGGDALLSSSLYPRQFDLNNSGNTGMELLNIRGTSAGAIWSIQNGAALGWILGRRAQSASRPGTRSVWQFSYNGEVIKSVAADNVGLQNQNGAGVGMLGDVLFRPYTGGTVSLGSPTYSFTRLRTTDWTIDTFGIVPVQDGIKNAGSASNRLGTIFAATGTINTSDARLKTDVRPMSAAEIAAASDLSSEIGFFRWVDSVDNKGEDSREHCGTTVQRAIEIMQEHGLDPFNYGFICYDSWDEQVELNDETGEVISTIPAGDRYSFRMDQLALFLARGVDARLQALEGA

SEQ ID NO: 53 - DNA, 2391 bp, Artificial sequence
  specific to K41
atggcactaagctggcaagagcaaatcaagccagctggtacccaggatatccagtgcgacattgaatatttggataagtcctatattcacgtgtacttagacggtactgagaccaccggatacacttggaccagctctactaatatcagattgaacacggcccttgaagcggataccacagtgctgcttattcgcaagacagagcgggagtacctgtatatcgagttcgccagcggctctccattcattgaggccaacgtagactctcagaatacgcagttgctgcacctggcgcaggaactagtagagggtcgcgccatccccggtttctacggggaattgagtatgaacgggtacagaattactcaggtggggaccccggaagaggataccgacgccgccaataagggttatgtagactctacggtggcggttacacagaatgatgtgaattctaagttcttgcgcaccatgcgtgccccagagtcctacatcggcctgctgccaccagctgccgcccggggtggccacttactggcctttaacagtttaggggaccctacgcctgtattaccggagtctgggagtgctgctgacgttatgttggacctagcctctgcagagacagggcaaggctctgcccttgtgatgcaccacaatggcgtgactgttgctgaaatgttggatactagggcagcgattagtgtactggaatttatccctacggagctttggcagtatataggtccggaggttaacgctgctgacgccatagccggagctggggacctatattcgtacattgcagcggcggatgctgttgcgtataccacggggaaagcattattctttccagccggacagtaccctatcagccaaacttataatcagaccgcgcgcgcggtgtttggcgtgttcggggcatcattcctagttgcacacccggacttcccaacaggagcttggctgcacacctggggattgcgcgccggtcagccgcgcctatccacgcttaacatgtcctacgacggactcggttactcccggggagattacgtgggaggctttctgttgggcactgggtgccatagttcagcagtcgatgggatattcgccaggaactgctggttaggaggttttcgtatcaacccccttggggcaacccgggacattgtaaactttctaatagaccgggtgtacttgttagattgtggttctgcttcgcattatccgggattctctattgagttgagtagtggtacgtccgctattactgacggtaccattcgaaacgttgacatctccggtactaatgcagactcctcggaaactgttgggccgatggcgttcacaataaccaccaacaacaaggcaatgtttaatgtggttatggaacgcttctttacctctacccggctaaatacccatgttaagactatatctaactcacgatatctctttacagggtgcgtaatgcggcaattctcaggagagactcacgcgtacgtaaacggggtagataccaacggatactttacagccttaccacaagtgtccctgcaggctggttatcgcaatcgctttgagcagatgtacgctcatggcgcgttaaacaatgctggcctggagattgttgatggcattgaacctgtgtttgtgcagtggaccttccagcctgggcagtatatggatatgagcggcaactatctgccggcattgtccatactggcgtgcgactatgctacgttccgagattgttcggttcgcaatttaatcagcaccagctacgatgccccatggaaacatgcgtttacgaagtacatgacagacaacggtacaggcactctgtgggaatcatcgcagctaaccagcaaccccgctgtactgcagggtcgggactactacagcgcactgacgcttaaatctggcagcactacgcggtactacccgacaaactctgtatcctacggcgctgacatagtgtttaacgcggctgatgggaatctagtgatgggtttccccgccacagcgaacgctactgatgaccaatccgtacagttcccgctgctgacagcccctgggcagggtggtgttagttactactacctaacggctaaggttactatgaccgctggggatgtaaataactggtatttggcgttccagatgtactctacattttggactcttacaccaacagccctcggtactgaatacattctgcacgctagatttcctgtaggtacgtctacgacactgaaccggctcataatccacatagggcactcttctgcagtgacgagtgcttgtagcttcacaatctcagagatagccctgtctcctgataggtacgtctacccattcaagtacaagaaagttaagcaggtggtt

SEQ ID NO: 54 - protein, 797 aa, Artificial sequence
  specific to K41
MALSWQEQIKPAGTQDIQCDIEYLDKSYIHVYLDGTETTGYTWTSSTNIRLNTALEADTTVLLIRKTEREYLYIEFASGSPFIEANVDSQNTQLLHLAQELVEGRAIPGFYGELSMNGYRITQVGTPEEDTDAANKGYVDSTVAVTQNDVNSKFLRTMRAPESYIGLLPPAAARGGHLLAFNSLGDPTPVLPESGSAADVMLDLASAETGQGSALVMHHNGVTVAEMLDTRAAISVLEFIPTELWQYIGPEVNAADAIAGAGDLYSYIAAADAVAYTTGKALFFPAGQYPISQTYNQTARAVFGVFGASFLVAHPDFPTGAWLHTWGLRAGQPRLSTLNMSYDGLGYSRGDYVGGFLLGTGCHSSAVDGIFARNCWLGGFRINPLGATRDIVNFLIDRVYLLDCGSASHYPGFSIELSSGTSAITDGTIRNVDISGTNADSSETVGPMAFTITTNNKAMFNVVMERFFTSTRLNTHVKTISNSRYLFTGCVMRQFSGETHAYVNGVDTNGYFTALPQVSLQAGYRNRFEQMYAHGALNNAGLEIVDGIEPVFVQWTFQPGQYMDMSGNYLPALSILACDYATFRDCSVRNLISTSYDAPWKHAFTKYMTDNGTGTLWESSQLTSNPAVLQGRDYYSALTLKSGSTTRYYPTNSVSYGADIVFNAADGNLVMGFPATANATDDQSVQFPLLTAPGQGGVSYYYLTAKVTMTAGDVNNWYLAFQMYSTFWTLTPTALGTEYILHARFPVGTSTTLNRLIIHIGHSSAVTSACSFTISEIALSPDRYVYPFKYKKVKQVV

SEQ ID NO: 55 - DNA, 2604 bp, Artificial sequence
  specific to K42
atggaccaagatattaaaacagtaattcagtaccctacgggagccactgagttcgacatcccgttcgactacctgtcaagaaagtttgtgcgagtgtctctggtgtcagattcagaccgcagactcctcagcaatattacggaataccgttacgtgtccaagaccaaggtgaaaatcctcatgcctaccactggtttcgatagagtggagattcgcaggttcacctctgctacggagcgaattgtagactttaacgacgggtcagtccttcgtgcgacagaccttaatgttgcgcagcttcagtccgcacacattgcggaggaggcccgtgatgctacccttctgactctttccttgacggactctggtgaacttgacgcccataaccgccgaatcatcaacgtggctcccggtgtcttacctagcgatgctgctacaaaggggcagattgacgaggtaatcggtgaggctggaggtattcttcaggaagtccaagagtcccagaagtggattaaggattacatcgacgagttcgtcaacgactctgcaaacttgaagctggtaacatgggtgtataacaatggtgcggcgattggtggtgagacttccataaccgtggatattcctgagcgagtgattgcagtaccagctctgtacgtgaatggtgcacgtaaggatgttgagtgggagtatgagttctcacctgacaccaaaataatcacactcaagacccctctgaataaaggcgactttgtaatctgcatactgtctgagagtggtacgccaatcatgaacttactcaacggcccaactggtgctaacgagatagggttcgctaacggtagggtgtcagatgcccttgggtgcacttggatttccatgtatggtgtcaagttgcagactgtgcagtccatcgcagcaggaaccgcagtggacatgactccgagaatccgagcagcaatcgaggccgcaaagaactctgatactccattgcagattgacgcagcgctccagactggcccaagtaacaataagttcttctacgttactgaacacattgatataaccgggcttcggactattaggggacctctgtatctcatggcgaacccggacacaatgaaggagactttcctcacgtcagacgaggttcctcgaccgtgtatgctcatcaacatgaacgctaagtacaccgatggtaagattcacttctctactacaaaaggtggtcagcagttcgatgagattcagacatcgttcgttaaggacccaccgcatgaccgctggataggccagttgcacacaacgtgttatacacacttccgtgggcagttgtggtcgagacgttgtgccatgcgctttgctaacacctacgattgcacattcggtgctcaggttgctgcggtagacgctgggagcatcaactactacgcgtttcaggtaggtaactatccgtggtacgacaaggtcgatgagtcaaacagcctgacattcccacgagttttagtacactctaacaagtatagggatattctcattgagggctctaagattaacatcaacgcttgtcacatcgaggcggcagtggttggtcctctcactggattagtacagaacacctatgacaaacaggcaccgggcggaatcgccacagcggtattcgggcctactggtggacagattggggtacttaactacaacattcacgtgaactcggcgagtcgtggatgtcttctggttaacaccatgggatgtaacgttagtcacatatttactgacgaccgagctgatgtggttgtaggggatatcttctacttaggacgtggtggctccataggctcaatctacacgcgctctgatgttaagactattggtggctctggcctgacgataggaaacatccgctgtggaggcaacctgtcaaacacggctgtgcgtactgcaatcgatgcggcctatgttggtgggcacctcttggtcaactccgggaagattaactacgcggaaatcggtggcaacgccactcaggaccagtacggttcaattcacggtggtaactgtaagggctcattcaccatggctaacagctcattgctcgaaaacttcaccatcaatggaccatacgtgagcacagcggcgagtccaactgtcatgcgctgtaccttcaatggctcctttaagaacactggaggtggtcactttgagcggtgcacactgaaagccttccctatagagtctaagctctctccgacgtactatcgatgtacactcactggcacagtaacctctggtgtagccggtgctaggtcgtacttcgacaagtgttcggttggttcttatgactttgacaatgcgcaagacgttatgattaccatcgacgggggcagcgctgcaggtatgacccagcagaactacagtggggcaatcctgatgactggcggtttccgtctgactggtagccgtaactctattccgggcttcaaggctcctactacgttctcggtgggctacggagctataaccatcaacccgtattctggtagagggtatgtgcttctgtggagcggtacacaggcccagtggcgagctacttcactaattgac

SEQ ID NO: 56 - protein, 868 aa, Artificial sequence
  specific to K42
MDQDIKTVIQYPTGATEFDIPFDYLSRKFVRVSLVSDSDRRLLSNITEYRYVSKTKVKILMPTTGFDRVEIRRFTSATERIVDFNDGSVLRATDLNVAQLQSAHIAEEARDATLLTLSLTDSGELDAHNRRIINVAPGVLPSDAATKGQIDEVIGEAGGILQEVQESQKWIKDYIDEFVNDSANLKLVTWVYNNGAAIGGETSITVDIPERVIAVPALYVNGARKDVEWEYEFSPDTKIITLKTPLNKGDFVICILSESGTPIMNLLNGPTGANEIGFANGRVSDALGCTWISMYGVKLQTVQSIAAGTAVDMTPRIRAAIEAAKNSDTPLQIDAALQTGPSNNKFFYVTEHIDITGLRTIRGPLYLMANPDTMKETFLTSDEVPRPCMLINMNAKYTDGKIHFSTTKGGQQFDEIQTSFVKDPPHDRWIGQLHTTCYTHFRGQLWSRRCAMRFANTYDCTFGAQVAAVDAGSINYYAFQVGNYPWYDKVDESNSLTFPRVLVHSNKYRDILIEGSKININACHIEAAVVGPLTGLVQNTYDKQAPGGIATAVFGPTGGQIGVLNYNIHVNSASRGCLLVNTMGCNVSHIFTDDRADVVVGDIFYLGRGGSIGSIYTRSDVKTIGGSGLTIGNIRCGGNLSNTAVRTAIDAAYVGGHLLVNSGKINYAEIGGNATQDQYGSIHGGNCKGSFTMANSSLLENFTINGPYVSTAASPTVMRCTFNGSFKNTGGGHFERCTLKAFPIESKLSPTYYRCTLTGTVTSGVAGARSYFDKCSVGSYDFDNAQDVMITIDGGSAAGMTQQNYSGAILMTGGFRLTGSRNSIPGFKAPTTFSVGYGAITINPYSGRGYVLLWSGTQAQWRATSLID

SEQ ID NO: 57 - DNA, 2904 bp, Artificial sequence
  specific to K44
gtggatatgaattctcataacccgtttaacacaggtggtagtgggtgcaccaatgattttcgttctgctgaccagttagtagaccgcatcattggggatgcttaccacgtagtaaaagaggtttaccttgcgttgggtaacctctcctacatctataactacctacagaagtatggtctgattattactgtagatagcgaggatgcaatcaaggatatcccattatcaattgggaagtttgctcgtatatacagcaaatcagatacgtctggttactactttactgattatctctatgtagccgatgacacaacaggcataccgtctaatgacccatccgcaactggttcctggattagtacaaaagctactggttctaatgcatcttttgtgcgtatctggaagtatcgtgctgttgctgacggtgagacggtaattcagctaccaactgatatgcctattgtggatgtacaaaccatttatgtacaaggtagtcgtcaggacgttggtgagggtttcgtctataacgaaggtgatgcaaccttaaccctggctgatgaacttgatgctggtaacttagttactgttatcattggtatctctgacccagatatggatattgatatctttgcgctgttaaagaaagaggacggggcttcgcagataggtacccttactggtgagaccgtacaagatgtacttacttctctacgtgaagagcaccagcagttagaagaaaatcttgctgccaatactggggcatctggcataggtactttacagggtgttcctttgcaggatttattatcatgggccaccccacaagcttttggggctaaaggtaatggtatctcagatgatactgacgctttatacgcagcattcaagtctacgtatgaaactatccatgtacccaaaggaacctacttaattactcgtaagttaaagtgtgcgttaactaaaaacctacgtgttatctgtgctccaggtgttgtgtttaaactggcagataatgttcgaaaaaacatgatggtctttgttggggaccgtacccacaactttgaatggtttggcggcgagttcgatggtaactgggctggacaaggcgaagagaccttaaacagctcaggttctttcaatgacatgtcccatgggtttattgtaagcctcttcaatgaagtgcgtttagatactatgtacgttcatagtttccgtgggcactcaatgaaccacgctggtaacaaaaagttgcacgcttccaatctgagatttaattctcacattgcccaggctttcccacaaggtgggtcccgtggtgatggtattactggttgctcagaagacgtacttattgagaacgtttacggctttaccaccgatgacatggtagcagtctttgctggtatcctttgggttgagggtggtactgaagcagactctgctatggtaacaaatttagattacctaacctgtaagtcagtaactattcgcaatgttaatccttggtataaaaccagtgatattgacccgaatactaccgtctatacatggaatggtgtagttgttggtggtcaaggtggcattggggtagagaaggtacacatcagcaatgttaaagggtatacccagtatagtggtgttcgagtaggtgcttctgacccagtaggttcagctcctgctacagactactggaatactatgggtagtgtaatcattgatgatattagtgtgcgagttgcgggtgcatctactaaccagcatctgtataaccctatccgcattggttccctgacagcggcaagtacaggcgaggcacatacctgccttattaattcccttgttctatccaatattcaactctggcctactggcaataaccggactctcattggtattgggtatactacgatttataacctggatatcaatagtattagcattcgtggtaactatgttgatgacacttactatgctattcactgtgctggggaccgccagattgcacaggttagtatcaatggtgttacccataacccaccaagcacctctagcgatactattgcgcaggcccagcttattctgtattgggctgttacttactcaaatacggcagctaagattagtttctctggtgttcccgctagaaggtcattagatggttcgtcttatctacctaacctattcatagcaaatggttcggtagctccatatgtgtatggttttgacgctgtaatccgtgcatccaataacttccactctttacctcgtgttaaaggtatttactgtactgaccggtatttaggccgggtacgggtctccccaaacacagggttatgggaatttttagattatgccactacgtatgaaagcagtacttttggtaagccttctgcgagtacattcagtaactatggtttgattacatggttacctgggatggttgttaagtgtgtgggttctcctaatgagtctattgattcatgggtgtataactcaaatggtgattggcagatgcagggtaagactgtaaccaataacatggtttctcttattacagtctcatctacaccatccatcatagcaccttatgctatgatgacttcacctgtttataacgatgctacatggccagaatcttatggtgttgttgcattgtacggtgggcaccagaacttacgtgctggggcgtatgaagactttgtatctactactggtaatacctatagaagaacctggaacactaatacttcagcatggaatggctggtacaggttacctcgtatagttgaggtacctgcttcagctactgcatctggggttgctggaaatattgcaatatcttctacatacctttatgtatgtgttgcgacaaatacctgggttcgcactgctttagcaacctgg

SEQ ID NO: 58 - protein, 968 aa, Artificial sequence
  specific to K44
VDMNSHNPFNTGGSGCTNDFRSADQLVDRIIGDAYHVVKEVYLALGNLSYIYNYLQKYGLIITVDSEDAIKDIPLSIGKFARIYSKSDTSGYYFTDYLYVADDTTGIPSNDPSATGSWISTKATGSNASFVRIWKYRAVADGETVIQLPTDMPIVDVQTIYVQGSRQDVGEGFVYNEGDATLTLADELDAGNLVTVIIGISDPDMDIDIFALLKKEDGASQIGTLTGETVQDVLTSLREEHQQLEENLAANTGASGIGTLQGVPLQDLLSWATPQAFGAKGNGISDDTDALYAAFKSTYETIHVPKGTYLITRKLKCALTKNLRVICAPGVVFKLADNVRKNMMVFVGDRTHNFEWFGGEFDGNWAGQGEETLNSSGSFNDMSHGFIVSLFNEVRLDTMYVHSFRGHSMNHAGNKKLHASNLRFNSHIAQAFPQGGSRGDGITGCSEDVLIENVYGFTTDDMVAVFAGILWVEGGTEADSAMVTNLDYLTCKSVTIRNVNPWYKTSDIDPNTTVYTWNGVVVGGQGGIGVEKVHISNVKGYTQYSGVRVGASDPVGSAPATDYWNTMGSVIIDDISVRVAGASTNQHLYNPIRIGSLTAASTGEAHTCLINSLVLSNIQLWPTGNNRTLIGIGYTTIYNLDINSISIRGNYVDDTYYAIHCAGDRQIAQVSINGVTHNPPSTSSDTIAQAQLILYWAVTYSNTAAKISFSGVPARRSLDGSSYLPNLFIANGSVAPYVYGFDAVIRASNNFHSLPRVKGIYCTDRYLGRVRVSPNTGLWEFLDYATTYESSTFGKPSASTFSNYGLITWLPGMVVKCVGSPNESIDSWVYNSNGDWQMQGKTVTNNMVSLITVSSTPSIIAPYAMMTSPVYNDATWPESYGVVALYGGHQNLRAGAYEDFVSTTGNTYRRTWNTNTSAWNGWYRLPRIVEVPASATASGVAGNIAISSTYLYVCVATNTWVRTALATW

SEQ ID NO: 59 - DNA, 2499 bp, Artificial sequence
  specific to K45
atggaccaagaaattaaaacagtcatccagtacccaacagggtccactgagttcgacatcccgttcgactacctgtcccgtaagtttgtccgtgtgtcgctggtgtcggacgacaaccgcagactgttaagcaacatcgctgagtaccgctacgtgtccaagaccagagtgaagctccttgtggacacgaccgggttcgaccgtgtggaaatccgcaggtttacctcggcgtctgagcgtgttgtagacttcagcgatggctcggtactacgagctgccgaccttaacgtttcccagattcaatcggcgcatatcgcagaggaagcacgcgacgctgcccttatggctattccacaggatgacgctggtaaccttgacgcccgaaaccgcagaatcgtacggctggctccgggtattgaaggcacggacgcaatcaacaagaaccagctagacaccaccttgggcgaggctggtggtatcctatcagacatgaaggacctagagggagagcttcacgactacatcgagaagtttgcagacgacacggcgattgtacgaggggtggcgtgggtgtacaacctagggtctgccaacggtggtgagaaagttattaccattgacaaaccaacccgaacgtatgctgtaccgtatattgcgattaacggctcgcgtcaggaggtgggatatcactaccagttcgacattaacacccagagtatctcccttgtgaagcctctggagaagggcgacttcttggtggcaatgaccacggagtcaaacattcctttggaatccatgctggcatctcccattggtgcatccggtattggtaccctaaacggaatgactgtgcaggagcggcttgatgcaatgaactcggtatccatccttgagtaccacaaagcgccatacgccaactttggggccgccttggaggctgctgctgctgcggctatgtcgaatgggagaggtacagtattaatcccagctggcaggtatacctcagagcgtgctgctaacatcaccttgagtaaaggtctccgccttgtgttcgcaccagacgcttgggttacatgctactcaccacatgatgtaattaatgttgacatcaatacgcagcacctgaatatcacagcaaacggtgctcgcattatggctgactgggcttttggcttagacgcatctaatgcagccgccatccggttaaaggacaacacactggataaatcgtgctctgtgacagacctgaaagtaggctttaaggctggaggcggtaagttcggccatgcgcttcactgtacagccgtgaacctctcgacgttctatcggtgcttactccaaggtgtctcagggattcatattgaatcctctaaggaccgtggtcagtatgcgcacgcaatgggtaaccaaattgtaggctgtgagatttacaccactgatgattcagtgaccattggcaacaaagggatgctcggttgtgagggcttactgattactggttgtcagttcatgagtgaagacacttgtgtgcgtattgacaacacagggttatcctcttcgacttacttacccccactgtttaggattgaaggtaaccacttcaactcctacagggcactgtacgcgaaggacttaatgcgcctttcattcattcacaatgatgtgcagctgcgacacacggctggtaagactccacgcggtgcgatagaggttggtggggtgcaggtattccatcatcacttcaacacgtactcctcatctagtgttggcggtgggaccgacgcggacaaagccacgtctgtataccagttccgtagtacgttacctaacgcgtacttcgttagctcaaacaacgtctactggatggatggtaacaccaagcctgtgtatgacttcgagtccacaacaggtagtgccataatccggtctactggcgaaatcctacagtcgctcggtacgtggaccactgcggaatacctcatgtacttccgtcctgaccagaccaccatcattggtgaccgtggggccgccgcaggtcttggacgtatcaatactgcggacttctctggcacagaggttgttcttcggcgcgctcccgctgtaggtgctatgtatatcttgagtaccgctgtgattcctaatcgctctaccatatcttcaataaagtgtcctgacattttggtaggtaagacggtagacatcaggatggatgccgctgaggtaacattcattcacggagtaaacctcttatgtcctgattggaagagcctgaaggtgtggttgcctaacacaatcagagtgtacttcataaatacatctcaggcgataatcattggaatctctgggattgaaacagcttcccatacagacgtcactacagagcctacctcaaggacttctccggggtatcacggtgcacgctacttctcagcccaaaatcagtacatctacaactacatcggcgggtacggatggtatcgcatcaaattcgaagcgttc

SEQ ID NO: 60 - protein, 833 aa, Artificial sequence
  specific to K45
MDQEIKTVIQYPTGSTEFDIPFDYLSRKFVRVSLVSDDNRRLLSNIAEYRYVSKTRVKLLVDTTGFDRVEIRRFTSASERVVDFSDGSVLRAADLNVSQIQSAHIAEEARDAALMAIPQDDAGNLDARNRRIVRLAPGIEGTDAINKNQLDTTLGEAGGILSDMKDLEGELHDYIEKFADDTAIVRGVAWVYNLGSANGGEKVITIDKPTRTYAVPYIAINGSRQEVGYHYQFDINTQSISLVKPLEKGDFLVAMTTESNIPLESMLASPIGASGIGTLNGMTVQERLDAMNSVSILEYHKAPYANFGAALEAAAAAAMSNGRGTVLIPAGRYTSERAANITLSKGLRLVFAPDAWVTCYSPHDVINVDINTQHLNITANGARIMADWAFGLDASNAAAIRLKDNTLDKSCSVTDLKVGFKAGGGKFGHALHCTAVNLSTFYRCLLQGVSGIHIESSKDRGQYAHAMGNQIVGCEIYTTDDSVTIGNKGMLGCEGLLITGCQFMSEDTCVRIDNTGLSSSTYLPPLFRIEGNHFNSYRALYAKDLMRLSFIHNDVQLRHTAGKTPRGAIEVGGVQVFHHHFNTYSSSSVGGGTDADKATSVYQFRSTLPNAYFVSSNNVYWMDGNTKPVYDFESTTGSAIIRSTGEILQSLGTWTTAEYLMYFRPDQTTIIGDRGAAAGLGRINTADFSGTEVVLRRAPAVGAMYILSTAVIPNRSTISSIKCPDILVGKTVDIRMDAAEVTFIHGVNLLCPDWKSLKVWLPNTIRVYFINTSQAIIIGISGIETASHTDVTTEPTSRTSPGYHGARYFSAQNQYIYNYIGGYGWYRIKFEAF

SEQ ID NO: 61 - DNA, 2007 bp, Artificial sequence
  specific to K47
atggccttagtcaaaatggtaaaagcaggtgtaccggtacttgacccactcgggttcactacccctgagcagtacggttacagccctgataattcccctagcgataacgctatatgcattgccaatgctctggctgcagcaaaggctcgaagctgcccctgtaagttctctgagggtacctatgtcagtaacaagattaccttggattatggagtggccattgaggtggcacctggtgcttacttggacttcaccctggtaatgcagggtgagcactttagctctgactactcagtagcaacctccctggcgtgggcagacgtcccagtaggcaccacggtgttcgccggtgacttctctgggtttagcgccggtgacgttatcgctattagcctggatgatgccattgggggcagtgctgcgcaaggcaacgagattggtacagacttcgcagttgtagttgcagctgacagtaactctctgactattacccccggtaccagatacgcatacacctccccggtgttccgtagactcgaggctgctacccagttatctggcacagtcagtgcagggacttatagcatctccggtaacttcgagggtgtattcgaagccggtgatattatacgtgttgaaaacattgctggtactgactccgtggaggcgcatacggcctacattgagtttgcgcgcgtagagagtgtcagcagcaccgcgttggtactggaccaggcgctgtactatgagcacattgacccatggctggtcaagacgggttggattagtaatccgcacgtacagggaggcgggcgtattaagcgcctggagattcgccaggcggcgttcccggaagtctgcggtatggaggtggaccggctaatctacggcttcacctacggcttagtcagctccggcatctacgctcgtggcgtacaagagccaagcaccattaaccacacctactgctttgggcgtatgcgtgtccaggatataaaggcgggtggcagcgttgcggttacagataacgcagcaatcaagttcatgtcctgtccaggtgcccagattagtgggcttacagttacggataccgtggctaccggtactcaaggtgactacgcagtgttcgtagatgctttttttacaccgtactactcctggaaccgggatatgcagttgcagggtgtaacctgtgaagcacctcggagccccgttacccgaggtgtgtggttctatggtgctgcagacagcatgttcaaggacattgtgggtgcgcaggtgtttctgcaaggttgctaccgcaccaccctgcgggacgtggttactccgcgctggcagatggagttgagggacctggtgcgctgcactgttaaggactgtcacgttaaaagcttcaccgctctcggctgcgatagtaccgtgtttagtatccgtacagacggtgtaggtactggtgctagtgccaacattgctggacgcttcggcggaggtacgcgcaatccagttactggtgctacctataacctaggaacgggcaaccgcattagcattcagagtgatagcactagcagcagcgccatcaccctgagcattgcgcagcaggactccttcattatcctgaatgggtgctgtgaccgtagcaccgttaacgcgagcatcgtactgggcaacaacgtaacgaacccgtttatggagccgaacagcctacaaggcgcggttggtgccggtagtggttggaaagggcctctgcagaagggcggcattgagttccggggtgactaccgggatggctacgttcgtctcagtggctactacgtatggatgtccagcactgggcagttgcgtgctagtgctactaagcctacctctgacgccccctctggattcattgcaatcggccctaatgctgcggcagccgtaagcaacagctctggtaccgacgcagccagtgtagctgtgaataacctcatggcgagcctacgtactgcaggtatcttgaagacctca

SEQ ID NO: 62 - protein, 669 aa, Artificial sequence
  specific to K47
MALVKMVKAGVPVLDPLGFTTPEQYGYSPDNSPSDNAICIANALAAAKARSCPCKFSEGTYVSNKITLDYGVAIEVAPGAYLDFTLVMQGEHFSSDYSVATSLAWADVPVGTTVFAGDFSGFSAGDVIAISLDDAIGGSAAQGNEIGTDFAVVVAADSNSLTITPGTRYAYTSPVFRRLEAATQLSGTVSAGTYSISGNFEGVFEAGDIIRVENIAGTDSVEAHTAYIEFARVESVSSTALVLDQALYYEHIDPWLVKTGWISNPHVQGGGRIKRLEIRQAAFPEVCGMEVDRLIYGFTYGLVSSGIYARGVQEPSTINHTYCFGRMRVQDIKAGGSVAVTDNAAIKFMSCPGAQISGLTVTDTVATGTQGDYAVFVDAFFTPYYSWNRDMQLQGVTCEAPRSPVTRGVWFYGAADSMFKDIVGAQVFLQGCYRTTLRDVVTPRWQMELRDLVRCTVKDCHVKSFTALGCDSTVFSIRTDGVGTGASANIAGRFGGGTRNPVTGATYNLGTGNRISIQSDSTSSSAITLSIAQQDSFIILNGCCDRSTVNASIVLGNNVTNPFMEPNSLQGAVGAGSGWKGPLQKGGIEFRGDYRDGYVRLSGYYVWMSSTGQLRASATKPTSDAPSGFIAIGPNAAAAVSNSSGTDAASVAVNNLMASLRTAGILKTS

SEQ ID NO: 63 - DNA, 1887 bp, Artificial sequence
  specific to K48
gtggactcctccctcatttatgaggtttctaaaatgacaacccctaccaataatgaaattcccagcaattccgtacaggatagaatgtacaatgctgaaaaatttgatgaatttatgaattcggataattccaactatactgaccgtaaaggaaaatccaggtggacgcttagtgggatcagacaggtgattagtaattggatgacgagtctggctggggatcaagggctgataaatatagggagatgttcagacgcctcgactttaagaactatcgccggacaaaaaggaaataggatagacctcaaaggagtttatgccgatgataagaggagcggcggttatcttctttggatagataatgcgagttatccggacgatggcgttgttttctttagggttaatagcgcgggcggttggataagagagaattggagcaaaggtattcaggcagaatgggcgggcgatctggtagaaatatctgacgcgacagataaattaaacaaaatatctaacgcactgaaaacctttaatgccgaagtcattctcccctcaggaaatatttatattggcgggacgtggtggttgacaacaggacaattgaagataagaggacaggggtcttccactcaattgatagggaagcccgttctttctactggggtggctaccaacgatcctatcattagaatttccaacgcaagttgggattcagtcactactaatgggcaataccgattacaggatgtggatttaagagatttttgtattgcgggtaaaaattatcctttaaaccccactacccagacttttgctcaatcttctcgagatgggttatttctcggtggcgtgggttgggattttcaagtacagcgggtgtggttttataatctaggtaggcgggctgttgtcgcggaagatctttgggatggggatttcttagattgtaaattacatgaaatttgtgtggataagacatttgcaccagcggattccatgcctcaggctatggcgtttaaaagaaaagttgattcgtgtaacgctattagggttacgaattgtcatttcgaacactgttatcgtggtgcaattaacgtccaagattattgttacttttttaatttaacaaataataagtttgaagcacagaaccagaataccggttatccaattgaatacccaatttatattgggaacaaccatagaggatttaattgggaagggggtatgtgcgtgttaagtcagcaagcaaattatctccattacgccaggatttttggggataacacaacgattaaaggtgtcgagtttcgtaataacaccaatgaaggtggcgcagccatattggatttaagttatggcaattacgggattggtggtcgtatcgagatcactggagatgtaagaggtgatttggtcgacctgtcaggaaatccggtctatcctattttaagtcgtacaggaaggaacgatttttcaggcacttttttaaaatgtttcaatccaggaagaatatttaatttggcgtcttccgctaacgctgatgatatatccaaagtcagagtgttgggattagggacggataccggtaataaagtcatcaaccaagctaacgtaatcaacagggttaatgggattcgatggtttggcgtggcttacagtctattaactgatatcacctctaaagcggatagagatgaatacgcaatgttgaagaacctctcatcgactgtgacattctcaatcggcgataatgtcgattcagcttcactcgccccatcttctgccacaggtgagaatacaggaacaggaacctcggtcgtcggcaattggaaatgtatgggctattgtcctcctggtaaggtatccttgtttaaacgcaattcc

SEQ ID NO: 64 - protein, 629 aa, Artificial sequence
  specific to K48
VDSSLIYEVSKMTTPTNNEIPSNSVQDRMYNAEKFDEFMNSDNSNYTDRKGKSRWTLSGIRQVISNWMTSLAGDQGLINIGRCSDASTLRTIAGQKGNRIDLKGVYADDKRSGGYLLWIDNASYPDDGVVFFRVNSAGGWIRENWSKGIQAEWAGDLVEISDATDKLNKISNALKTFNAEVILPSGNIYIGGTWWLTTGQLKIRGQGSSTQLIGKPVLSTGVATNDPIIRISNASWDSVTTNGQYRLQDVDLRDFCIAGKNYPLNPTTQTFAQSSRDGLFLGGVGWDFQVQRVWFYNLGRRAVVAEDLWDGDFLDCKLHEICVDKTFAPADSMPQAMAFKRKVDSCNAIRVTNCHFEHCYRGAINVQDYCYFFNLTNNKFEAQNQNTGYPIEYPIYIGNNHRGFNWEGGMCVLSQQANYLHYARIFGDNTTIKGVEFRNNTNEGGAAILDLSYGNYGIGGRIEITGDVRGDLVDLSGNPVYPILSRTGRNDFSGTFLKCFNPGRIFNLASSANADDISKVRVLGLGTDTGNKVINQANVINRVNGIRWFGVAYSLLTDITSKADRDEYAMLKNLSSTVTFSIGDNVDSASLAPSSATGENTGTGTSVVGNWKCMGYCPPGKVSLFKRNS

SEQ ID NO: 65 - DNA, 2670 bp, Artificial sequence
  specific to K51
atggggtattttcaaatgaccagaaacgtagaagaaattttcggtggggtagttgtcgcaccccaccagatcccgttcacgtatacttcaacaaacggtggggaaactttcctttccctgccattttatcctatcaccgggttcgttactatcaacggtggtgtacaggttcctcttgataattttgaaatagacgggaatacattaaaccttggtcgcgaactggaaccaggggatgttgtattctgtctgtttgataaaatcatgtctcctcaggatgcgagtaatcatgcaattcgtatctacaaattcctttctgtcgggggtgaaacagaatttactcctgatttcacggcatatggtgtccagtctttgtacatagacggaaaatacaaaacgcccggtgaagattacaactatttcaaaacttccaacaaagttgttcttgacaacggattggctgcgggagtttgggtagttgctgagatgaacataaagcagaatattcctgctttagctgaaaacaacggcgcctctaacattggtacatcatttggtattacggtagaggatgccctaaagcgtgatgctgtagtttatgctgctgagttcggcgtgactggagacggtatcgcctgtggttctgcatgtgtagcggctattgaatatattatgcggaatggtggaacgctggtgttccctaaaggtgaggtgaactggggaactactcgccatcaatttgctatctataatggcaagccttgtactatcaaaggttctgatggtggaaccacctggacatttgataatgtcgatccggttgctaatgactcaggtgcagcatggccttttagtgaaccgttccttgttgaatttggtgggcaaccaaccatacaaggtgtctttgtagagcctgtaactgttgaaaatctcactattgactatacccgtcaagctaacaaaggtgggcctacttatgagttgatgggaataggggcacatcctacaccttattcggatggcactcttggtctgcgttttagttattgccgttcaccagtagtgcgaaatgtcacgatgaatgagatttatggctctggtatccagttctggaaatgttctatggctttagcagagaacaatcggctatacaacgtctcagctaaccaacctttaggttccggtaacaatgagtctaaggatcactttggttgggctatctggtctggtgcaagcccaaaaacgattatccgacgtaacactgcaattaataagcgtgttttcgtatgtgatccggcattgaaatctcctaataacaatgtggtgtataacggtactctttgtggatatatcggcattttcgcggagtacgggagcaatggcggtacttctaccatctacccgccggactttgaatggcaggcagatgcatctgccgataagagaacttacattaccctggaagataacctcgtatggggttacaccatgtccattaagtctgaggcaaccacctcagctcgaatcattaataatacgctgctgaatcactatatcggtgtatctgttcaggcatcggctgatgttgtaggtaactacatcaatggattacaggctgattcacaaaaatgtccacagaacggatttgagttacaacgtggtggaattatgctttcttggtggtcctcatctgtacaagaccatcgacattacgtagcacaaaactatgtttactcggctgcgtacaactgcatttccattggtaaggcttatgccacaatagatgataaccagtttacgatcacggggtcagccaggtttataaactcggtaacttccttcaacgtagacttgctggagatgcggggtaacaagttcctgatggctgaatcttgcacgcaggcagttcccatgcgtgtcaccaactgttcgaaggtggtgatggaagctaacttaatagagaataaaagtcccacagtgcgtctgtcagtgcagatgataaaccctgtaatacgcaacaatactttcaaagggtgggttcagttatatctggcatcgtccgacagtatagtggaagagaacacatccacagatactgttgcaaataaaggattggtactgcaagtagcgtcagcagacaactgcattatccgtagaaaccgtataaccaaatataatgttgatgacgaagatcagatattcttcttatccaaagcctcgagaacggtcattgaaggtaacaccataaactacgatgcagggactggtgcaggaagaacgaagaacatacctgttataaggacattcggaacctgcttttacaccatgatactcaacaacagggttactggtgatagtagtgccacgtttggttttactctttttgacggttcgtcgggtgcgatggttttggaatgccgtggtaatagcacagataatgcaactcgtcagatgtttacaatgtattctcagcgtggtccttggttcatttctggaaacgattggacacagacatacagctctgaaataaatactgcaaccaatatctatgcgtcgtataaaccagctataggtgagaaagtgccatatcttcgtccacaagctgggggtgctgaagggattgtttatacggcatctggatggttaacatttggctctatagcttcagca

SEQ ID NO: 66 - protein, 890 aa, Artificial sequence
  specific to K51
MGYFQMTRNVEEIFGGVVVAPHQIPFTYTSTNGGETFLSLPFYPITGFVTINGGVQVPLDNFEIDGNTLNLGRELEPGDVVFCLFDKIMSPQDASNHAIRIYKFLSVGGETEFTPDFTAYGVQSLYIDGKYKTPGEDYNYFKTSNKVVLDNGLAAGVWVVAEMNIKQNIPALAENNGASNIGTSFGITVEDALKRDAVVYAAEFGVTGDGIACGSACVAAIEYIMRNGGTLVFPKGEVNWGTTRHQFAIYNGKPCTIKGSDGGTTWTFDNVDPVANDSGAAWPFSEPFLVEFGGQPTIQGVFVEPVTVENLTIDYTRQANKGGPTYELMGIGAHPTPYSDGTLGLRFSYCRSPVVRNVTMNEIYGSGIQFWKCSMALAENNRLYNVSANQPLGSGNNESKDHFGWAIWSGASPKTIIRRNTAINKRVFVCDPALKSPNNNVVYNGTLCGYIGIFAEYGSNGGTSTIYPPDFEWQADASADKRTYITLEDNLVWGYTMSIKSEATTSARIINNTLLNHYIGVSVQASADVVGNYINGLQADSQKCPQNGFELQRGGIMLSWWSSSVQDHRHYVAQNYVYSAAYNCISIGKAYATIDDNQFTITGSARFINSVTSFNVDLLEMRGNKFLMAESCTQAVPMRVTNCSKVVMEANLIENKSPTVRLSVQMINPVIRNNTFKGWVQLYLASSDSIVEENTSTDTVANKGLVLQVASADNCIIRRNRITKYNVDDEDQIFFLSKASRTVIEGNTINYDAGTGAGRTKNIPVIRTFGTCFYTMILNNRVTGDSSATFGFTLFDGSSGAMVLECRGNSTDNATRQMFTMYSQRGPWFISGNDWTQTYSSEINTATNIYASYKPAIGEKVPYLRPQAGGAEGIVYTASGWLTFGSIASA

SEQ ID NO: 67 - DNA, 2160 bp, Artificial sequence
  specific to K52
atgattaatatggcatacagctggcaagagtcggtagagcctgcaggtacccaggatatccagtgcgatattgaatacctggataagtcctatattcacgtttacttagacggtgctgagaccactgccttcacttggaccagctccaccaatattcgtctgaactcgccgctatctgcagagacggcggtactccttattcgtaagactgaacgagagtacctctatattgagtttgctagtggtgctccgttcattgaaggcaacgtagatactcagaatatgcagctcctgcacctggcccaagaactagttgagggacgttatatcgagggattctacggcgacattaacatgcaccgttaccgcatcacgaacctgggcgatgcggtggatgcaatggatgctgctaacaagcaatacgtcgatgccggggatgcccggctagaccaacgtattgatgcagaggcagccgcccgtacggctgcagatgcagccctggacgtacgcaccactaatctagagcaaacctacttcaatgcaaatactaacagcttctcatggtggacgattacaaccgaagatacaaacactatcatccccggaatgccgtttacaaaggccaaggtaaggctaaacggtataacgaagactgctggttactcttacagtattagtgataacacagtagtgttcacagaaactattcctgcaggtacgttggtggatatgaccattggcgtggacacagaagcagatacatccgccgtgtctactgtgctaacactgctgtcagcggagagtggtgcaggctatattggtggccttaactacgttacgcctgaaatgtccggactattaacgggcgtaggtaatgctgacgacgatacggcagctatccagtgggcgctgagccagaacgcagcactggttgtcctagactcaacgaaaacctacaacgtccatccgggagttattcaacacaccgggaaagtcaatgttgatgccggggcagctaaaattgtctgtgacggtatagctgttgatattattgacggtgctggttccgtatggaaaggtggcaacttactcagcaaaacaaccccgtggacagttgtgtatgacgaagatttcaacattgttgaaagcggaaccttgggttatgggcgtatgccttaccaggacgacacaaacgtagacccctctcattattaccagcaaatttgttgcaccctagtatttcggtcttctacttcgtctgttcttgacggattaactgtgtctgatgtaagcggcagctacgccgcagtggtagcagccggtttcagaaatactaagtggacgggcaataaaataagaggtggggcgctggccggggctattatggtgctcaacgactgtgagctacctgttacggctggtttcggttggaatgctggtgcagacgtgtcttatggaaaccctttcaaatgggcgcgtggtagcaatcacaccttcgtaaactgtgacctctttgaaggtcggcagatggggctttgtgtcactggttcagattacgtgactatctctaacgtcaatacatacgataatgcagagtctggagtgcagacagggcaatacagctccgcgtacccacaagaaagcatcgtatgtaagcatgtcactcagatagggtgtaaatcgtgggggaactattatgatggccttgaccatgccgcagtaacgagcggtgctgctggcccatacttcgagaaataccttaacgtctctaactgtgaggtattcaataaccgcgccaccggtatatttgcccagggcggcaatcttcaaattaagggcaataatttccacaacaacggtactcacgggatacgaatccaggattcatccgtggttgatgtttcacggaaccaatgcatctataacgggaagctggctggtggttatcaaatactggccgtaggttcagatatgtctgtggatgacaacacagtcttgaatacctcacagaccaattcccacttagtaaacattagtattggatcacaggccgtactaaaatttggtgctaagttccgtaataccccactgagtacgagatcatctccgaaaactgtcatcggtgtgggcgtactgatgtccgggcacagagaaaacatc

SEQ ID NO: 68 - protein, 720 aa, Artificial sequence
  specific to K52
MINMAYSWQESVEPAGTQDIQCDIEYLDKSYIHVYLDGAETTAFTWTSSTNIRLNSPLSAETAVLLIRKTEREYLYIEFASGAPFIEGNVDTQNMQLLHLAQELVEGRYIEGFYGDINMHRYRITNLGDAVDAMDAANKQYVDAGDARLDQRIDAEAAARTAADAALDVRTTNLEQTYFNANTNSFSWWTITTEDTNTIIPGMPFTKAKVRLNGITKTAGYSYSISDNTVVFTETIPAGTLVDMTIGVDTEADTSAVSTVLTLLSAESGAGYIGGLNYVTPEMSGLLTGVGNADDDTAAIQWALSQNAALVVLDSTKTYNVHPGVIQHTGKVNVDAGAAKIVCDGIAVDIIDGAGSVWKGGNLLSKTTPWTVVYDEDFNIVESGTLGYGRMPYQDDTNVDPSHYYQQICCTLVFRSSTSSVLDGLTVSDVSGSYAAVVAAGFRNTKWTGNKIRGGALAGAIMVLNDCELPVTAGFGWNAGADVSYGNPFKWARGSNHTFVNCDLFEGRQMGLCVTGSDYVTISNVNTYDNAESGVQTGQYSSAYPQESIVCKHVTQIGCKSWGNYYDGLDHAAVTSGAAGPYFEKYLNVSNCEVFNNRATGIFAQGGNLQIKGNNFHNNGTHGIRIQDSSVVDVSRNQCIYNGKLAGGYQILAVGSDMSVDDNTVLNTSQTNSHLVNISIGSQAVLKFGAKFRNTPLSTRSSPKTVIGVGVLMSGHRENI

SEQ ID NO: 69 - DNA, 1761 bp, Artificial sequence
  specific to K54
gtgtacaaccccgcagacaataactggtattcatggtcgggcactctgccaaaaattgtatcggcaggggaagacccgacggcggacagtaactggaagccacgtaccgaccaattattgcggcaaaatctttcagcggaaagtggctcatccttgattgggtataaacaagggaattctggaacactcccatataccgtgtatgcaagattaaaaactgcgctgaatctcttcgattttatacccgtggaaaaacatgatgctattgttaatttcaccagcacagaagacctgtcctcttacgtgcaggcggcgattgattcagcaaatacgatgggtggtgcaaccatacattgccccgctggtcaatattatttgaatgtcaaaacaaaaccgaatgttatattggttggtgcaagagggccatccgttcggcgagccatgccgtgggctttttcagtatcggctaaccctgggtctacgagattcagaaactttgctaacgactggattatatcatcggcaaccgcatcacaatcggatgttacttcccgtagctttggcataattggtatagattttgacgcgaaagacgccaccaatagcacaggcggtgttcgccttcgtggccctgaaatatgcgttaagtcttgtagtttttacggttttcaggaccaggggcttgaagcaagcggaaacattggactttttgaagacatcattgctaatgaatgtctaaaaaacagggtgagaacagattatgttgggaccatcgagatatctggcgcatcagactgccagattcaccgactggaaggtaacgcacaggtaaaaggccttaattcaataacgaacgctgcgccgtatatctgcggtataaaaatagcaggtaataaccattatgtctctgcactaatgggcgagatatctgaaacagggatatatattagcgctagttcagttcatcataaaatgtggggatgccgagcggataacaacgttggcccgggatacctcattaacggcgtaatgatggacacatgccattcttacaataactcacgcacaggcgacggattgtattcaggttttgaggcactccccggagcgactcgcataatggcttccaactgcttggcgtggacagataacgcaccggtagatggtacaggtcaacaacgcttacataaatatgggtacgattttgcggttgtagactacttatcgttaaggttgaagccttgggttgaccaatgcttttcatacgggcattcattaggatggataaactctccgcctacgtatgggttacagtataccccaacgataggtagattatctgtaactagtaacgctacgacaacccctaacgtagatggggttagtgtcatcgctataaatactacatcattaagtcaaataacaggactaaatggtggtatgataggccaacaggtagatatttatctaaacgcatcggctactgttacacttgttaatagttcatcatttttagttaacaacttggcggaccatgcggataaaactatgcgagtaggtcaggtatacagattcgtcaagactgcaacaaatatctggcgagaagttggcgatgttatacgtgttttatcagggacaaccgcttccagaccaagttcaaccgcggttgctggcatgcaatattttgatacaaccctcaataagccaatatggcgtaatgcggctaactcaggatgggttgatgctactggtacggctgtt

SEQ ID NO: 70 - protein, 587 aa, Artificial sequence
  specific to K54
VYNPADNNWYSWSGTLPKIVSAGEDPTADSNWKPRTDQLLRQNLSAESGSSLIGYKQGNSGTLPYTVYARLKTALNLFDFIPVEKHDAIVNFTSTEDLSSYVQAAIDSANTMGGATIHCPAGQYYLNVKTKPNVILVGARGPSVRRAMPWAFSVSANPGSTRFRNFANDWIISSATASQSDVTSRSFGIIGIDFDAKDATNSTGGVRLRGPEICVKSCSFYGFQDQGLEASGNIGLFEDIIANECLKNRVRTDYVGTIEISGASDCQIHRLEGNAQVKGLNSITNAAPYICGIKIAGNNHYVSALMGEISETGIYISASSVHHKMWGCRADNNVGPGYLINGVMMDTCHSYNNSRTGDGLYSGFEALPGATRIMASNCLAWTDNAPVDGTGQQRLHKYGYDFAVVDYLSLRLKPWVDQCFSYGHSLGWINSPPTYGLQYTPTIGRLSVTSNATTTPNVDGVSVIAINTTSLSQITGLNGGMIGQQVDIYLNASATVTLVNSSSFLVNNLADHADKTMRVGQVYRFVKTATNIWREVGDVIRVLSGTTASRPSSTAVAGMQYFDTTLNKPIWRNAANSGWVDATGTAV

SEQ ID NO: 71 - DNA, 2256 bp, Artificial sequence
  specific to K56
atgacaacaccaaccaataacaatattcccagcaattccgtacaggatagattgtacaacgctgagaagttcgacgaatttatgaattcggataatgccaactacaccgatcgtaaggggaaatcccgctggacggtttcaggtatccggcaagccgtcctaaactggatgtcatctttatcctcaccgtcaggggcttcggcgattggaacaacagccgggacgacggttcaaagctatatcgacgatttaatagggacgcaaggcttttccgtggtaggttcttgtgactcagtcgatcaattaagaataaccgagcctaaaaacgataaaagtattgttctccttagaaaggcggtcccggcaggacctactttaaactcgcttatttggtacgactcttccgactcaacgagttctgataacggtgtatcggtctttgtcaccccaggcggggctagatggaaggcggatctttctaatggctatgatctaaggatggcgggcatcttaatagacggaagtaatttttcccagtgttttaataaatgtgtttctgcaatcattagcaccgcagtaactaataatcgcataaacaacatcgtcaaaactattaaggttaaaccgacaaattttataaacgaattcactttgacggaaaccttaaagatgccttcctttgtttcggtcgatttcatcggcgggcctttcttagaagccgcatcgctaacagatgttgatgttgtaagaatctgcaactgcgattttcctacattaacaaaagaaatgtttcaagctgaggctggtcccgccggcgctagcacagcctccaacaatcaggctataggaagaagagcttttggctgctcggatggtaatcgaattactttaaggggccccggatacggtctcaacgcagcccccccttacgagccgacgtatacctcggtaggagtggtaataggtaatgatgtggcgacaacaatggatgttagggatatccatttggccgatataaacattatagggtttcataccgggattaaatggggtggattttatacgttcatgtgtggcgtcgtcgactttaatattagtaaatgttggaacgcagtagaggtcccagaggcatttagtaattttggcgaaaggatgttttatcatcaaggaactttgggcaacattgggaattacggcttctggataaagggagcgggcgattttactcttgaaaacgtcagcactgatttcatagggtcggatttagtccattttggatccgcctctccaggagaacacaagcatctttctggtcatattgaaggtgtacagggttaccttgtaaacaaagacacccccacatcatattccaaatcactggcctattttggaaaaatagtcaggagagatgacagggtgctttcgatcaccacttcttccggtaagattctgaaggattatcgtggggtgagacctttattccactgcccttcaacttcttacgggaaaatgttgaaagttatcgatgggtcgtatgcacctggcagggagggcgcgactccttacgccgagtactgttgtatgacgggcgggcctaacgaccagggagtagaactaataccggaaagagatactttcatagacactccttacattaattcttatgttgacgggatcaggaaaagtgttaaccgagttataagtttcaccacgtcgacgggtccgctgggcattgatcctataagcacggattacgctttcgcagcaatttgttctggttcggcaacatgtcaatatggtagtgctgctgacgcctcttccgatggaatattgccgttcgtcataaccctgacctcccctaccgaagtagtcgatttttattgcaccaaccaatttaggataaatgctgggtacgacgcgctatgggccacgtgttccgtcaaactcgggaatgcaacagggaacgttaccatcacgcctataatgaggaattaccttaagacccaagcggtatttaacgcctcgaataacactgttgctttaaaccccatactgagaaacacttccatcgggtatccgattgatatgactgcctcgttggccgattccggaaaattatccacggaattctttgggatgcagccaaggcaaataccatctggattttacttaggaatggattttagtgtcgccgggtttagaataactggttacgtagggacaatctatttgaaattacctgtatggtatgtaaaa

SEQ ID NO: 72 - protein, 752 aa, Artificial sequence
  specific to K56
MTTPTNNNIPSNSVQDRLYNAEKFDEFMNSDNANYTDRKGKSRWTVSGIRQAVLNWMSSLSSPSGASAIGTTAGTTVQSYIDDLIGTQGFSVVGSCDSVDQLRITEPKNDKSIVLLRKAVPAGPTLNSLIWYDSSDSTSSDNGVSVFVTPGGARWKADLSNGYDLRMAGILIDGSNFSQCFNKCVSAIISTAVTNNRINNIVKTIKVKPTNFINEFTLTETLKMPSFVSVDFIGGPFLEAASLTDVDVVRICNCDFPTLTKEMFQAEAGPAGASTASNNQAIGRRAFGCSDGNRITLRGPGYGLNAAPPYEPTYTSVGVVIGNDVATTMDVRDIHLADINIIGFHTGIKWGGFYTFMCGVVDFNISKCWNAVEVPEAFSNFGERMFYHQGTLGNIGNYGFWIKGAGDFTLENVSTDFIGSDLVHFGSASPGEHKHLSGHIEGVQGYLVNKDTPTSYSKSLAYFGKIVRRDDRVLSITTSSGKILKDYRGVRPLFHCPSTSYGKMLKVIDGSYAPGREGATPYAEYCCMTGGPNDQGVELIPERDTFIDTPYINSYVDGIRKSVNRVISFTTSTGPLGIDPISTDYAFAAICSGSATCQYGSAADASSDGILPFVITLTSPTEVVDFYCTNQFRINAGYDALWATCSVKLGNATGNVTITPIMRNYLKTQAVFNASNNTVALNPILRNTSIGYPIDMTASLADSGKLSTEFFGMQPRQIPSGFYLGMDFSVAGFRITGYVGTIYLKLPVWYVK

SEQ ID NO: 73 - DNA, 3816 bp, Artificial sequence
  specific to K57
atgactaatatcaaggcccgcaagggtggttcaagcaagccacgtactcccgtagaaatgccagataacctgatctcaaaagataagatcaagttgttgcttgccgtttcggatggcgaggtggttaacgacttcagcctgaagcagttgcattttggcggcgtcccggttcagaacgaggatggaacattcaactatgagggcgtgattgcagagttccgccccggaacgcaaacgcaggactacattcagggcttcagcgagtcaagtgctgaattccaggttgctcgtgaagtaactcacaacacgccttatacgcttaccgtatcgaacaaaaatctttctgctattcgctttcgcctgttatggccgcgcgtgctgactcaaaaagataacggcgatatggtcggatcggttgttgagtacaagatcgagatggcggtagatggtgcaagttatcagacctacctaactggcaagattgacggtaagaacacgactggcggttacgatcggagcattcgcgttaacctgccgcaaaacttcacgtcgcaggtgcttatccgcgttagtcgaattacgccggacgctgacggggtgaaggtagtcgatgccttccaggttcagtcctacgctgaggtgattgatgcaaaattccgctacccgttgacggcaatgctttacgtcgagtttgatagcgatctgttccagaatcagatcccgacaatctcgctcaagaagaagtggaagattgtccaggttccgagtaactacgaccctgttaacaggacgtatgccggaacgtgggacggaactttcaaatgggcgtggagcaacaacccggcttgggttctttacgacctgatcatgaatcagcgttatgggttagaccagcgcgagttagggatcccggtcgacaagtggtcgctctatgaggtgtcgcaatactgtgatgagcttgtgccggataatcgcggtgggatggaaccgcgttacctgatggatatggttgtgcagtcgcaggtcgaagccttccagttggtaagggatgtttgttccgccttccgtggaatgacgttctacaacggggaaagcctttcgattatcgtcgataagccacgcgatccggtttacctgttcactgctgataacgtcgttgatggcgtattcgttcggacgttcccaagcgaaaagacgatgtatacgtcgtgcaacgtcatgttcgacgacgaagaaaaccagtacgaacaggatgttgaaccagtattcaaccctgacgcagccatgcggttcggccacaacccgaccagcattacagcgatcggatgtaccagaaggacggaggcgaaccgccgtgggcgttggattctgcaaactaacctaagcgccacaaccgtttcgttttctactggtctggaaggtatgattccttcttgcggcgatgtaatttacgttgcagatccgcactggcaatcggcctttaacctggtgctatcaggccgcgttatggaagtgtctggcgtgcaggtgttcctggcctaccgctgcgacgcgaaggctggcgacactctgatcctgaataccgacgacggcaagccagtgcgccgcacaatcgccagcgtttctgcggatggtaagaccctcacgctaaatgttgggtataactttgacgttgcgccggacagcgtattcctgatcgagagtgatcagcttgcagcggaacagtatgtagtaacccggattgaaaagggtagtgatgacgacgaattcaccttcgccatcacggctacgcagtacaacccgaacaagtatgacgcgatcgacaacggagtaattaccgacgaccgaccaacttcggttgttgacccggattcaatgggcgctccgaaagacttaacgattagctctttctcccgcattgttcaggggatgagcgtcgaaacgatggtgatcggctggtctgccgtgcagtatgcaaaactgtacgaggtgcaatggcgcaaggatggaggtaactggaacaacgttccgcgcactgcgacaacgcaggttgatatcgaaggcatctatgctggcgagtaccaggcccgcgttaggtgcattagcggcgggaatgtagcgtctccgtggtctgctttggcaaccgccacactgaccgggaaagtcggagcgccaaaaggcccgattaacctttttgcgtctgacaacgagatcttcggcattcgcgttaagtgggctatgcccgaaggagcggaagacacggcatacattgagctttaccagtcgcaaagcggaaccgatcaggacgcaagcctgcttacactgattccttacccggcggctgaatactggcattcaattttgcccgctggatatgtgaactggtataaggcgcgaagtgtcgacaggatcggcaacgtttcaccctggactgattacgctcgcggtatgtcttcgactgacgttaacatcatcacagatgcgatcctggatgagatcctcgatagcgacgcgatgaaggagctacaggaaaacgcacaggatagcgcggcaaaactcaatgactacgcgaacagcatcattcaaaatgcgctggcgaatgatgcagacgtcagggttatgcgcaaggagaacggcaagcggaaggctgagatcgcgcatactacggtgctgatcgccaacgaatcagaagcgcgggcggctgaaattacgcagcttaaagcgcagattgatgaagatatcacatcgcagatcacgacccttaacgaagccctggcgacggaaagcgagacgagggcaacgcagatcggtcagttgcaggcagattttgcggctgatattgacggcgtaaaaacaaccatgaacgctggttttacgcaggttaatcaggctattgcaaatgaaagcgacgcgcgggcaagttccgaggcggcgctagatgccaaaatcgggcagaactccgcagcgctaaatcagaaactcgactcgtgggcaaacgttaatggcgtaggttccatgtacacgatgaagttaggcctgaagtacaacggacaggaatacaattccgggatggccctacagcttacctcacagggtggaaacgttgtttcgcaagttctgtttattgctgatagattcgctatcatccgaaatgcggagtctggagcgtacactttgccgtttgttgtgcagaatgaccaggttttcatgaataacgcgcttattcaggatgggtctattaccaacgcgaagatcggtaacgtcattcaatcaaacaactacatcgccgggcagcaagggtggatgattaacaagaacggaggatctgagtttaataacgttaccgttcgcggccatatagaggctaacagcggaacgttcaagggcacgcttgaggctcagagcttcataggtgatattgcagttgccagaagatatgatgacttgagttttcgcagaaacaacaccgttcagcgtgacgggtactatcaaaatcgcggttatagcatgacgatagttcttagttgcacattaatctatgaggttacaggggataataatgtcagaaacggctatgttgttgaaattacgttcaatattggtgggcagcaggtaactagacttttcccagttaacccaatgctaacttatggtagttatgccgctgaatttcgcttttctgctgatattccagcaagttacagtaatacttatttctttgtgaaagcgaaagggagagacgcaaattgggattatagttgtaaagttgagaacatcacggcaaccgcattccgcacaaactcaaatagcttttca

SEQ ID NO: 74 - protein, 1272 aa, Artificial sequence
  specific to K57
MTNIKARKGGSSKPRTPVEMPDNLISKDKIKLLLAVSDGEVVNDFSLKQLHFGGVPVQNEDGTFNYEGVIAEFRPGTQTQDYIQGFSESSAEFQVAREVTHNTPYTLTVSNKNLSAIRFRLLWPRVLTQKDNGDMVGSVVEYKIEMAVDGASYQTYLTGKIDGKNTTGGYDRSIRVNLPQNFTSQVLIRVSRITPDADGVKVVDAFQVQSYAEVIDAKFRYPLTAMLYVEFDSDLFQNQIPTISLKKKWKIVQVPSNYDPVNRTYAGTWDGTFKWAWSNNPAWVLYDLIMNQRYGLDQRELGIPVDKWSLYEVSQYCDELVPDNRGGMEPRYLMDMVVQSQVEAFQLVRDVCSAFRGMTFYNGESLSIIVDKPRDPVYLFTADNVVDGVFVRTFPSEKTMYTSCNVMFDDEENQYEQDVEPVFNPDAAMRFGHNPTSITAIGCTRRTEANRRGRWILQTNLSATTVSFSTGLEGMIPSCGDVIYVADPHWQSAFNLVLSGRVMEVSGVQVFLAYRCDAKAGDTLILNTDDGKPVRRTIASVSADGKTLTLNVGYNFDVAPDSVFLIESDQLAAEQYVVTRIEKGSDDDEFTFAITATQYNPNKYDAIDNGVITDDRPTSVVDPDSMGAPKDLTISSFSRIVQGMSVETMVIGWSAVQYAKLYEVQWRKDGGNWNNVPRTATTQVDIEGIYAGEYQARVRCISGGNVASPWSALATATLTGKVGAPKGPINLFASDNEIFGIRVKWAMPEGAEDTAYIELYQSQSGTDQDASLLTLIPYPAAEYWHSILPAGYVNWYKARSVDRIGNVSPWTDYARGMSSTDVNIITDAILDEILDSDAMKELQENAQDSAAKLNDYANSIIQNALANDADVRVMRKENGKRKAEIAHTTVLIANESEARAAEITQLKAQIDEDITSQITTLNEALATESETRATQIGQLQADFAADIDGVKTTMNAGFTQVNQAIANESDARASSEAALDAKIGQNSAALNQKLDSWANVNGVGSMYTMKLGLKYNGQEYNSGMALQLTSQGGNVVSQVLFIADRFAIIRNAESGAYTLPFVVQNDQVFMNNALIQDGSITNAKIGNVIQSNNYIAGQQGWMINKNGGSEFNNVTVRGHIEANSGTFKGTLEAQSFIGDIAVARRYDDLSFRRNNTVQRDGYYQNRGYSMTIVLSCTLIYEVTGDNNVRNGYVVEITFNIGGQQVTRLFPVNPMLTYGSYAAEFRFSADIPASYSNTYFFVKAKGRDANWDYSCKVENITATAFRTNSNSFS

SEQ ID NO: 75 - DNA, 3279 bp, Artificial sequence
  specific to K58
atggctaataaacccacgaaaccaaattttccgcttgggcttgaatcacaagatcaatccgtatttcaagaaggtattctgaataatggtgttatagaacatggcccagatgcggttatgactgtgccagaaactcctgacgcatctggggttccttctgctgtccgttataacgaagacgacgatcaattcgaaggctactacaacgaaggcggctggttgccgcttggtggcggtaacggtgggcgctgggaactccttccgtatgcctcctcttccctgttacaagcaggacgtgcatatctggtagataatacggacggcgtctctacggtgctgttcccttcccctaaacgtattggtgacagtgttactgtctgtgacctttatggtaaattttccacttatcctctgactgtagacggtaacggtaaatcgatctatggctctgcggatagcatgacgatttctaccgataatgtcagtgcgactttcacatggactggtgaagcccgtggctgggtgataacttctggtgtgggcctgggtcaaggccgggtttatagtcgcgaaatttacagccaaattttgtcagcgacaacaccatctattaccctgagcacccaaccatctattgtagatgtgtacgttgacggaaaacgtttgaaagaatccctctatactctcgacgggtatgaagtcaaattcgatccggcgttggcctctggttctgatgtgcagattattcagtacatcccaattcagctcggcgcaggcggcgggggttctggtggtactgtgatcacctgggaatacaacggtggttcagctatcggcggcgaaacccaaatcgtgttggatgtggtcgtggactcagtatctgaaatctatattcgcggccagcgtcaacaaatagggcgcggatttacatttgatcctgccaccagtacgattaccttggcggatgaactggaagccggggatgacgttgtcgtcgttatcaacggtgacccgacggtttacaaccagatcgaccgtactccttgggaagttgctcgggcaaatagtgttaaattatctgaagttatccttagcaccgacaaaaattccgcattagacgagaaaattgttttgtttgacgttacttcccaaaaacattggggaatacctaaaggggatatcccctctggttccaaaataatttctatttctgggaaaacgctgacttacacaggggggcaaactgtaacattaatagatcccccgaatagaataagcatcagaaatatctggaaaacccgtttgggtatgttagggttaaatttagtacctggcagctttgaagacggtgcccaaattcaaacgaacacggatgccgtcattagttttacggatggtgtttgttatacgtggggttctgatctccccaaaatcgtccctgtagacagtacccctctgacgaccggtggaatttctgataatggttggaccaatactaatacgattctgggcgtcctggcatctaaagtttttttggaaaataaaggaactgcccaagatgctatcaactatttgactttggatatgtatccttctgtgggtgatggggtcacagatgatactgtgtctattcaaaattgtattgacgatgccacgacacagggtaaatctatttatgtacggggtaataaaaaatacaaattaaccgatagattgaacgtgacatgtaacataattggagatggtacttgtacctttcaacaggttactgattctaaatcttgtttagaaattactgtagatggaatttctgtcagtatgataaacgttacaccttcaccggtagtttcgtctgcattacaatttgcagggatagtgataaaaaatgccaacaaatgcaaggtggaaaattgtaatgttttctatgttggaagaactgacagagaaggcagtggtatagggatttataacggtaatgacaatattattgcacattgtagagcttctggcgcgaacttggcgccaggaactcgccatgattatggtggaaatgatttctacgtctatggtaattcatcaaggaacagaatttataagacagtgggtattggcgctaatatcagggggataatgcaacaaactactgtgttgggacaacaatgtaattacaatgaatatgatagcaatatcagcataggacaaattggttatgggcatatttgctatgaactaaaccatgatagcaacacgagtatggtgggcaccatattcaggaatgggtttgttgctaatatttcaggatctgctgtagatcctactagtggcaacaaattctttggtgctggggtatacaaccaagagggacaagatactagaatagaaggttattacatttacaacgtttgtcaagatgacggcatccaacaaacattgccgatggctggaatatccagtactcggggagacattaggataaaaaataattttatatctttgtctaagagatgtggtataaaagtttcaacatctggtataggcggggatgaaaggactgccagtatttttgataatactgtaaaaaatgtcactgatgaggcagtttatttagttaacaccaaccgttcacaaataaacggattgaatgtcgtgaacagtggtagagcggtaagagcttcttcaaatacagattactcaaaaagtcatataacggttagtggcgtaacaattaaaagttcttctgggattcttttagatgggttttctaccgcaatagtagaagacattcaaggagaaacctgtaatggtatgttcaccgctcagaatatacaatatttgttggcagacaaattagtcagtaacggtgataatgcgacaggtatttctataacatcaactgttgttggcgggtttttaaggaatagtatatctgtaaatggttccgttggtttcaacttggcgggaaggattgtttatgaacgcttagttggagaaggaaacgtaacgaattttacggggttgtattctgggataactacactgcccaacactgcttcagttgacgtgaaaaatttaaacttcgtcgctattggcacaggaacagacatagcgacgataaccgggggggtcactaatcagatgttaacgatcagggcgactgcacccaggacaatagttcataatacgtcttctataatattaaaaggcggtgttaatttaactatcggggtgaatggaacgttacaattgtggtgtatagatggaactcgatggttagagatt

SEQ ID NO: 76 - protein, 1093 aa, Artificial sequence
  specific to K58
MANKPTKPNFPLGLESQDQSVFQEGILNNGVIEHGPDAVMTVPETPDASGVPSAVRYNEDDDQFEGYYNEGGWLPLGGGNGGRWELLPYASSSLLQAGRAYLVDNTDGVSTVLFPSPKRIGDSVTVCDLYGKFSTYPLTVDGNGKSIYGSADSMTISTDNVSATFTWTGEARGWVITSGVGLGQGRVYSREIYSQILSATTPSITLSTQPSIVDVYVDGKRLKESLYTLDGYEVKFDPALASGSDVQIIQYIPIQLGAGGGGSGGTVITWEYNGGSAIGGETQIVLDVVVDSVSEIYIRGQRQQIGRGFTFDPATSTITLADELEAGDDVVVVINGDPTVYNQIDRTPWEVARANSVKLSEVILSTDKNSALDEKIVLFDVTSQKHWGIPKGDIPSGSKIISISGKTLTYTGGQTVTLIDPPNRISIRNIWKTRLGMLGLNLVPGSFEDGAQIQTNTDAVISFTDGVCYTWGSDLPKIVPVDSTPLTTGGISDNGWTNTNTILGVLASKVFLENKGTAQDAINYLTLDMYPSVGDGVTDDTVSIQNCIDDATTQGKSIYVRGNKKYKLTDRLNVTCNIIGDGTCTFQQVTDSKSCLEITVDGISVSMINVTPSPVVSSALQFAGIVIKNANKCKVENCNVFYVGRTDREGSGIGIYNGNDNIIAHCRASGANLAPGTRHDYGGNDFYVYGNSSRNRIYKTVGIGANIRGIMQQTTVLGQQCNYNEYDSNISIGQIGYGHICYELNHDSNTSMVGTIFRNGFVANISGSAVDPTSGNKFFGAGVYNQEGQDTRIEGYYIYNVCQDDGIQQTLPMAGISSTRGDIRIKNNFISLSKRCGIKVSTSGIGGDERTASIFDNTVKNVTDEAVYLVNTNRSQINGLNVVNSGRAVRASSNTDYSKSHITVSGVTIKSSSGILLDGFSTAIVEDIQGETCNGMFTAQNIQYLLADKLVSNGDNATGISITSTVVGGFLRNSISVNGSVGFNLAGRIVYERLVGEGNVTNFTGLYSGITTLPNTASVDVKNLNFVAIGTGTDIATITGGVTNQMLTIRATAPRTIVHNTSSIILKGGVNLTIGVNGTLQLWCIDGTRWLEI

SEQ ID NO: 77 - DNA, 1839 bp, Artificial sequence
  specific to K62
atgaataagatgtttacccagccatctggtccggtggctaaacagaccaacaagcaagctattgcaagagtcaacggtattaagcagtcagaggttgggtttttaaatactctggtggacatcgattcatataaagttttatatgatgctgctactcaaacttcctggtttaggggggatgctataggtacacctatcaactgggctgtgctaggtaataccttaactctagttacgtcagtgggggaatttaacctagactccaccaatctccgtcaaaaccttgcatcaagcggcaaagggttgggagatgaacttgttactacagaatatgatatcccggttcgtaaatatataggcaactcatcgccacgcatttcgaattacaaagtggaaaaaggtggtgacgcgactctagcttttgcaaaggctttcattaaagcgactgaaactacaggtgtcgtaattgtcgatgtcagttgtgtggttgatacaattgctattccatcaggaataacaatcaggatagccgactataagacagtcacccacaaagctaatgcctcagcacacatgtttatcttgtcccctgattcgttaatcaaggcaaataataaaaaaggccgcttgaggggaaactctgctaatcagtcagctatacgtcgctgcataagtgctgttggcgtttccgatgcaggggttgatggcgttgatatccgtgatttcaatagttacggtgcgtattttgagaactgcgaagacaccttttgcaaaaattcaacaatacgtgatatcaccgggggagcagtagaaactgctgctgggcaatatgtaactaactgcctgcgtcataaatctgcattcaatgatatcagggatacaggttctaacggtatcaagttcagagcggatactttaggtcaaacacaaggatgtagctcgaccaacgataaggtatatcgtgctggttttattggaattgctaatggtaagtgtaaagaccataccgtcactaatgcctattgtgagtcatgcgttgacaatggctgtgatatgaatggttgctacaatacgcggtttatagattgcgtatcagtaggttgtcaggacgggttctacatgggtgaaaatgggattgataattgtcacataatcaacccaactgcccgtaactgtaaacgttctggggtaggtagccttggttccctgacaagatgctctgtgataaatccaactattgatgcctgtggtagcggtatctattgctctggttttgtaggctttaaaatcagagatggcagcattacaaacagtgtaaaacagacgtacactgacaacgaaacgggtactgtaaaaacgagcaccggtaacggtatcgatttacaatcaaacttgtcgggatgctaccaacctgacatctctggaactactttttatggtaatgctggttacgatattgcctttggtagttctggtactattggtaacttaatgcttggcgaatgtattttccaggattcagctggagatggaaaaattaactatggcggtgctactcttgccgacccacagattagaaattcccagggctatatcgtctcccggacacaggcttacaatttagctggggatggtactacactggattttacactttcgctgccgcaggcagttgctgatgcaaactatcgtattgtttctgttgtgccggattggctaactactgcccgatatctcgatagtactaaagggacttcctatttcggtatttcattcggtagtgctccgccatctggaacacgtcgtgtaaacattatgtttgaacgccttcgcccaatt

SEQ ID NO: 78 - protein, 613 aa, Artificial sequence
  specific to K62
MNKMFTQPSGPVAKQTNKQAIARVNGIKQSEVGFLNTLVDIDSYKVLYDAATQTSWFRGDAIGTPINWAVLGNTLTLVTSVGEFNLDSTNLRQNLASSGKGLGDELVTTEYDIPVRKYIGNSSPRISNYKVEKGGDATLAFAKAFIKATETTGVVIVDVSCVVDTIAIPSGITIRIADYKTVTHKANASAHMFILSPDSLIKANNKKGRLRGNSANQSAIRRCISAVGVSDAGVDGVDIRDFNSYGAYFENCEDTFCKNSTIRDITGGAVETAAGQYVTNCLRHKSAFNDIRDTGSNGIKFRADTLGQTQGCSSTNDKVYRAGFIGIANGKCKDHTVTNAYCESCVDNGCDMNGCYNTRFIDCVSVGCQDGFYMGENGIDNCHIINPTARNCKRSGVGSLGSLTRCSVINPTIDACGSGIYCSGFVGFKIRDGSITNSVKQTYTDNETGTVKTSTGNGIDLQSNLSGCYQPDISGTTFYGNAGYDIAFGSSGTIGNLMLGECIFQDSAGDGKINYGGATLADPQIRNSQGYIVSRTQAYNLAGDGTTLDFTLSLPQAVADANYRIVSVVPDWLTTARYLDSTKGTSYFGISFGSAPPSGTRRVNIMFERLRPI

SEQ ID NO: 79 - DNA, 1890 bp, Artificial sequence
  specific to K63
atggcactcactaaactggtagatgctggagcctggcaagtagaagtagccccagctggcacggtgcaagattccttggtattcttatccccacgcaacttcggtggagtaccaggcactggtgtagatagtgtagcagctatcgaagccgccctagcggcgggcaacgtagacttaggtggtgagcactggtttattagcaggcccatctattgcgtatccggccgtaccattcagaatggtaagatttctaccctagcagcccggggctctgggtttatgactggtagtatcttcgcacctgggaattaccatcctgtatacgtagacccagtaccgaagctggcgtgctcaagtacaaacggctcagccactattacagtaagctctcacgggttcgtagttggggatttagtgcgcctcagcagtactcgtgggattattggcagcgatgccgtgctggttccgtggtatatgcagctggcgcgcgtagtgggggtgagtggtgacacggtgaagttggacgcaccggtagacactacggagaccctggtagtgcacaaagctaccccggccggttataatgcacgcttcgataaacctctgtttgtgcttgagcgcgctacgttccggaacattgaagtcgatacctgggactattggaccgccgactccgctacgtttgagtgtacctttgaaggtattcgtggcaaggctaggtcggtagtgtacggcaatactttctgccgcaccacctttgataatattgacatcacgttcagtaacaaagcctctgagatggcgtttggtagtcacgacacaaacttaagcaacatcaaattccgagcggatgcccagaactgggatagcactaactcggtaggtatctcctgggctgagtccgggcggcgttgcaccttggataattggcagctgctggtgcctcaaggggtgagcttgagtgttcttgttcgcatctcctctcacagggatgtgcagattcgcaaagggttcattcaggttcacagcagcagcaacaacatcctgagcgtggagcactatggtggagaccgtcctccgtgcaacaatatcttgtttgaggatattgacgtgaatgctacgggtgccgccgcggtggttgtggacgtatataaatccgctaacgattcggctattaatgctgtgcggtttgagggtatcagctaccgcggagctactccaagtgtagcgcttatgcggcagcgtggcacctcctccaaccaggtttcgggtgtacgcgcaagcctatacagcgcaaacggtggtgctttcgtagttagctctgcgatggcttgggatgtgcgcctgtacggtccggggctgcaagtaccggctgcggttgctgttctgggtaagactgcggtactgagtgcttcccgtagtaatctgcatgccctgcgttgggttacagaggcaatcatcggggtaactagcactacccccgggaatgtcctgagagaggctgttattcctgccggtactcttcgggctagtgattacatcgacttcgtaatcagcggtagcactggtggggctacgagtactaaggatgtgcgtgtaggtgccattgactccggctctaacttccaaggtatcgggttcactgcacctactaccgaggaatcctactacactgtgcagggccgtatcagcttccctactaccggtaactgtctgattacagcaactattggtagagcgggggtaggggtgagttacgctcgtactttggtgaatatcagtaactacactactaatgatgtgaagctgcaggtccaagcatgggttggttctagtgcaggaagcttgagtgtgcagcacggctgctttgctccagcggaactcactggt

SEQ ID NO: 80 - protein, 630 aa, Artificial sequence
  specific to K63
MALTKLVDAGAWQVEVAPAGTVQDSLVFLSPRNFGGVPGTGVDSVAAIEAALAAGNVDLGGEHWFISRPIYCVSGRTIQNGKISTLAARGSGFMTGSIFAPGNYHPVYVDPVPKLACSSTNGSATITVSSHGFVVGDLVRLSSTRGIIGSDAVLVPWYMQLARVVGVSGDTVKLDAPVDTTETLVVHKATPAGYNARFDKPLFVLERATFRNIEVDTWDYWTADSATFECTFEGIRGKARSVVYGNTFCRTTFDNIDITFSNKASEMAFGSHDTNLSNIKFRADAQNWDSTNSVGISWAESGRRCTLDNWQLLVPQGVSLSVLVRISSHRDVQIRKGFIQVHSSSNNILSVEHYGGDRPPCNNILFEDIDVNATGAAAVVVDVYKSANDSAINAVRFEGISYRGATPSVALMRQRGTSSNQVSGVRASLYSANGGAFVVSSAMAWDVRLYGPGLQVPAAVAVLGKTAVLSASRSNLHALRWVTEAIIGVTSTTPGNVLREAVIPAGTLRASDYIDFVISGSTGGATSTKDVRVGAIDSGSNFQGIGFTAPTTEESYYTVQGRISFPTTGNCLITATIGRAGVGVSYARTLVNISNYTTNDVKLQVQAWVGSSAGSLSVQHGCFAPAELTG

SEQ ID NO: 81 - DNA, 3051 bp, Artificial sequence
  specific to K64
atggaccaagatactaaaacaatcatccaataccccaccagtggtgacgaatacgatatcccctttgactacctgtcgcgtaagtttgtccgtgtgtctctcgtatcggatacccagcgcgtcttactggataacatcacagattaccgttacgtctccagaacgcgcgtcaagctgcttgtaagtaccgatgggtatagccgtgtagagattcgacgcttcacctctgcgtccgagatggtcgtggacttcagcgatgggtccgttctccgcgcgaccgaccttaacgtgtccgctctacagtctgcacacatcgcagaggaggctcgtgacttattcagcacatccctgagcattggccaacttagctactttgacgctaaaggcttgcagataaagaatgtagcagcaggtgttgacaataccgatgcagtaaccgttcagcagctcaacaagataatcgctgacgtcgtgaccaccatccctgacagtgtggcagataacatccggggcctttgggcgcgagttttaggtgacatcggaatcacgcttgttgacggcagcttcgagaccggtgcaaccattactaccagaactcaagcactgtggtccataagtggccgtaagtgctatacatgggctggtgctctgcctaaggttgtcccagagaactctaccccagagtctacaggcggtatttccgaaacggcgtgggtggatagttcctccaaggccctcggtgtacttttggctggaccatctggagctgagcgcgtcggtctcaagcagggcggtaccgttcaggacgccattaattggttgacgttcgactccttcgacatcgtaaaggatggttcaaaagatgtcacggcagatattatggcagcctgcgttgtagccaacgacctcgggctggacattaagcagaacgacgggacatacctagtgtctgggaaccctgtgtggcctgtgtacaactctcttgacctcaacggggtgacgctgaaattggctgcgggtttcactggatacttcgcgctgacccagaaggactccacaacggtttacgggccaactagtcctatcgttcaggccatcaatgcggctggtggtcggacagctggttcaggtgttctggaaggtctggtgaactctaccgagctgaatgggaagttcctgttcatggagggctctgatgtcctttactactcccgaggaaccgctaagtattggtgggcgaacacctacctgtcaaaccgtggtaaactgagtgacaaccttaagtatggcgtatcggctatcacgaagataacggcggttaccccgcgaacgaagattgtctactaccgtctgccaaatctggactttggtaacggccctgcaaacaacggtgtgattcgcgtactgaacaacacccggttcattatgcaaggcggctcaatctccaaccgtccacttaaggatgtgtcaaagagtccggtcataatcagcctcaactactgtgcagccttcaaggcgtacgacttcttcgacccgtatccggcctttgcggtgaattccaataactcactcgtctactcctacaccctgaacttcaacgacatcgctgacgctgtgtttgagaacttcaactctcagggatatggttggggtgtggttggcggacagcgctctaccaacataacctatcgtgactgtaaccttaacagggtggatatgcacgacccttacatggggtacctgaaggttctggacacccgcttgggcacttggggtatcaatgcttcaggcatgggtgatatgtacttggagcgcgtcacggtcgatttggacgattcggcacatggtggctaccgagagcacgagggcatcattaacgctcgtggtgactttggtgggttccatgatggtggtctgtacattaaggacctgacaatcgtcggcgaggcttccgcattcgaggcagcatctggacacccagtggcgctggtctctgcgtactccttcaacgcatcccttgcttatatccccgagtcctctccggttacgccgtggggcttcaaggaggtaatcgttgagggactgcactgcccgttcaagcggactggtcgtcggttcaactctatcatctccgccccaagtattcagttcactgtgtatcacccgatgcgggttaaactggaggactgtaacttcaactctacggcgttcgagaagttcgacctgaggggctggagggttactccgtacaacccttcgaaggttggtatcgcgaacactctggcattccgtcctacgaactttgttgatgtgaaggactgctcgatggttggccttgagttcacccgaccgactcgtgcatacgactactctaactttgacgtaaacctcgttaacgttaagaatgtagaggaacactccctgtctccgttcactctgtacactaaccagtgtggtcgttataacttggttgggtgcggtctgcaacagattgtggacaagtcgatgacttcgggtgagcgcgcaaaccgtcggagcacgttctcggtgactggcggtacttggaactcactttccggtaaccctacggatataacctacggtaacggctacgacatccctgtggtggcgactggtgttatgttcgttggtccgtactcccagactgaagtgacaggcgcaaacttgaacgttgcagagtttgttcaggcgtccggctgcaagttcctcagttccggcccgacctacatccagccgttactctggagtggggcaggtggtccaactggagcgagtgctaacttcaacgtggcacgcgggaacactctgggcctgaacatctctgcggtgaacggtgagacgtctcaggttatcgcggcgactctggtgattccgcaagggttctcaactggcccggctgccggtacaacctacgggttcgccgtggaaaagaacatcaactaccaattagggcttaacgcccgcagcctgaaggcgaacgttggtttagtgcgttgtagtgataccataaccggggtgtacctgaacgca

SEQ ID NO: 82 - protein, 1017 aa, Artificial sequence
  specific to K64
MDQDTKTIIQYPTSGDEYDIPFDYLSRKFVRVSLVSDTQRVLLDNITDYRYVSRTRVKLLVSTDGYSRVEIRRFTSASEMVVDFSDGSVLRATDLNVSALQSAHIAEEARDLFSTSLSIGQLSYFDAKGLQIKNVAAGVDNTDAVTVQQLNKIIADVVTTIPDSVADNIRGLWARVLGDIGITLVDGSFETGATITTRTQALWSISGRKCYTWAGALPKVVPENSTPESTGGISETAWVDSSSKALGVLLAGPSGAERVGLKQGGTVQDAINWLTFDSFDIVKDGSKDVTADIMAACVVANDLGLDIKQNDGTYLVSGNPVWPVYNSLDLNGVTLKLAAGFTGYFALTQKDSTTVYGPTSPIVQAINAAGGRTAGSGVLEGLVNSTELNGKFLFMEGSDVLYYSRGTAKYWWANTYLSNRGKLSDNLKYGVSAITKITAVTPRTKIVYYRLPNLDFGNGPANNGVIRVLNNTRFIMQGGSISNRPLKDVSKSPVIISLNYCAAFKAYDFFDPYPAFAVNSNNSLVYSYTLNFNDIADAVFENFNSQGYGWGVVGGQRSTNITYRDCNLNRVDMHDPYMGYLKVLDTRLGTWGINASGMGDMYLERVTVDLDDSAHGGYREHEGIINARGDFGGFHDGGLYIKDLTIVGEASAFEAASGHPVALVSAYSFNASLAYIPESSPVTPWGFKEVIVEGLHCPFKRTGRRFNSIISAPSIQFTVYHPMRVKLEDCNFNSTAFEKFDLRGWRVTPYNPSKVGIANTLAFRPTNFVDVKDCSMVGLEFTRPTRAYDYSNFDVNLVNVKNVEEHSLSPFTLYTNQCGRYNLVGCGLQQIVDKSMTSGERANRRSTFSVTGGTWNSLSGNPTDITYGNGYDIPVVATGVMFVGPYSQTEVTGANLNVAEFVQASGCKFLSSGPTYIQPLLWSGAGGPTGASANFNVARGNTLGLNISAVNGETSQVIAATLVIPQGFSTGPAAGTTYGFAVEKNINYQLGLNARSLKANVGLVRCSDTITGVYLNA

SEQ ID NO: 83 - DNA, 2409 bp, Artificial sequence
  specific to K65
atggaccaagaaattaaaacagtcatccagtaccccacagggcccactgagttcgacatcccgttcgactacctgtcccgtaagtttgtccgcgtgtcgctcgtgtctgacgacaaccgcagactgcttagtaacatcaccgagtaccgctacgtgtctaagaccagagtgaagctcctcgtggcgaccactgggttcgaccgtgtggaaatccgtaggttcacctcagcgtctgagcgaatcgttgacttcagtgatggctcggttctccgcgcgacagaccttaacgtttctcagttacagtctgcacacatcgctgaggaagcacgcgacgcagctctactggctatgcctcaggacgacgctggtaacctcgatgcgcgtaaccgcagaatcgtaagactggctccgggtattgatgacacagacgcaatcaataagaaccagctggacaccactttaggggaggctggtggaatcctatcagacatgaaggacctagagggagagcttcacgactacatcgagaagtttgcagatgatgcggcgctggttcgaggcgtggcatgggtgtacaaccttgggtcagccaatggtggtgagaatgctgttaccatcgataaaccaaacagaacgtatgccgtcccatacatagagattaacggctcgcgtcaggaagttgggtatcacttccagttcgatattaacacccagcgtatctcccttgtcaagccgttagagaagggtgacttcttgatggcaatgaccactgagtcgagcgttcctctggaatccatgttggcgtcggctgcgggtgcaagctccgtgggcaaacttggcggcggtactgttcaggacttcatcaccaacactgagtcaaaaattggcagctttagtgttcttgaggactttgggccagttggtacacctgcggatacgtctgcaactttactttcagcactttcatccggcaaaccaatagtgttgaccagaatgtattcgcttcctatgcgtacatttagcctaccgagtggaactacgctgataggactaggggctaaaactggcttcaaggcggcagaaggtactgagctattcgtcaatctactggaggtcggtgggaccgatgtgctactctccaacttcgcaatcactatggatgcggcagggcgaggatccgttggaagcgttgcgtgctatggggtacacttcctcgccagctctcgtggtaaccgtgcccaaggacttaagattactggcaaggccgtagggtctacagtagggttcactcacggggttcgctgtaatggtgttcgtaacgttgtggacaagtgcgatatacagtattgctcaatggggataacccttcggggcgagtaccataagattacgaacaactacctgaacaaccattatgtggacgagaaccttgggccttggactcatgcgagtatgttctgggacggaatcactggtgaaggttgcatcaactgcgagattagtggaaacatctcagagtacaatgggcagtctggaatctactttggtggtaacaatagccttagtcaaggtttaatcatcaccaataatatatgccgctacaactacaaccgtgggtgtgacaccggaatctctgggacagcttctgacacaaacaacgtgatagacgtaacgtactcgagtaatattctcgagaacaacagggagacaaacctgtggctcttcggtgtaagcgagtcaacgttgattggtaaccacatccgggagacagccctgtatgacacactgttccctaaccaagctagtactacccgagcaggacttgcactgggcggactgacgtgtaacaacaatgagatagtagggaacaacatccgtgtgcgctctacgacaccatttggaatcgtacttaacggtaccgggcattacctggcagccaaccgcaggattggtggtgcgtccaactacatcttcgctagtgataaccagcgtttggtgggtaactctattgagcgatatacagggtcattcactccaactttggtgggcaccgctggcataaacgtcacatctgccacaggtcgctatgagattcaacgtaacgtactaacggtggaaatcaacatgacgctgtccgcaaatggtgctacaggtgctatcgccatcgggtacatccccggtctgtcttcggtcacaccagtaatgcgtgacattaaagttacactgcttaatgggtggcttccggctctgggcgataagaccatactggctcgtgagggtactagcaatgacttgttgaacctcgtagtgttttcctatggtaaccagtctaacgaggtggctcagtatgttggcccagcgtcgtccctgagaattaccgccacattcaacacctcatctaccttatta

SEQ ID NO: 84 - protein, 803 aa, Artificial sequence
  specific to K65
MDQEIKTVIQYPTGPTEFDIPFDYLSRKFVRVSLVSDDNRRLLSNITEYRYVSKTRVKLLVATTGFDRVEIRRFTSASERIVDFSDGSVLRATDLNVSQLQSAHIAEEARDAALLAMPQDDAGNLDARNRRIVRLAPGIDDTDAINKNQLDTTLGEAGGILSDMKDLEGELHDYIEKFADDAALVRGVAWVYNLGSANGGENAVTIDKPNRTYAVPYIEINGSRQEVGYHFQFDINTQRISLVKPLEKGDFLMAMTTESSVPLESMLASAAGASSVGKLGGGTVQDFITNTESKIGSFSVLEDFGPVGTPADTSATLLSALSSGKPIVLTRMYSLPMRTFSLPSGTTLIGLGAKTGFKAAEGTELFVNLLEVGGTDVLLSNFAITMDAAGRGSVGSVACYGVHFLASSRGNRAQGLKITGKAVGSTVGFTHGVRCNGVRNVVDKCDIQYCSMGITLRGEYHKITNNYLNNHYVDENLGPWTHASMFWDGITGEGCINCEISGNISEYNGQSGIYFGGNNSLSQGLIITNNICRYNYNRGCDTGISGTASDTNNVIDVTYSSNILENNRETNLWLFGVSESTLIGNHIRETALYDTLFPNQASTTRAGLALGGLTCNNNEIVGNNIRVRSTTPFGIVLNGTGHYLAANRRIGGASNYIFASDNQRLVGNSIERYTGSFTPTLVGTAGINVTSATGRYEIQRNVLTVEINMTLSANGATGAIAIGYIPGLSSVTPVMRDIKVTLLNGWLPALGDKTILAREGTSNDLLNLVVFSYGNQSNEVAQYVGPASSLRITATFNTSSTLL

SEQ ID NO: 85 - DNA, 2337 bp, Artificial sequence
  specific to K66
atggcattcagctggcaagagtcggtaaagcctgcaggcactcaggatattcagtgcgatattgagtacctggataagtcctatattcacgtttacttggatggtgctgagaccactgccttcacctggaccagctccaccaatattcgtctgaactccccgctgtctgcagagacagcggtgctgctcattcgtaagactgaacgagagtacctctacattgaatttgctagcggcgcgccgttcatagagggtaacgtagacacccagaatatgcagctactgcatctggcgcaagagctggtcgaggggcgttatatcgagggtttctacggtgacattaatatgcaccgctatcgtatcaccaacctaggggacccagtagatgcacgcgacgctactaataagcagtatgtagacactggggacgcgcgcctggatgctcggatagacgctgaggctgcaacccgcaaggccgcagacgatgccctggacactcgggtaattaacttagaacaaacctattttaacgctaacaccaacagcttttcctggtggactgtgactacagctccgacaagtaccattacaccggggatgctgttcactaaggctaaggtgcggctaaacggcataactcaaactgcaggttactcatacagtgtggaaagtggtgttattacttttgcagaaactgtccctgctggtacattagttgatgtcactataggtattgatacggaggcagacacctctgcggtatctgctgtattagacctgctggcttccccacaaaataacggggcaggtgtaaatgtagtccacttaacaggggcggctacagtaccatttgagagattcttagcagactccgggtggaatatggatgcagctatacttgcagccgccgcttccggaaagactgtactgtttaggaacgacgaaacctacaccatctcagtaaacgatattccgtttgcccggtatactagttttataggtaatcctggaggaaatcccccactgttcctcatcactaacccaaccggcacctacggtacgtttaacctgtatgtagctaatgggttgaatgggggacgttataataagtttgacaacctaagtttccgataccccaatcaggttaaaacaggcagtgctattccttacccaccactttttgctgggggttgttatggtagcgagtttactaacctagacattgggaatgcttatattgggttcagattaggcggtacacttaactctgtagagttgggggcagctagccgggtacgattatcagacatcattggtgctccgctatatagagggctcagcttagagcaggtacgagacgttccaactattcaaaacattaggtggaactacaactacttagatggaggcccatacgcttatgattccaccttaaagcagtggatgcatgataatgcctgggccttccaatttggcagattggactggtctttagtttccaacctatttgcctacggatacctgcgaggggtcgtactccttagtacgcggtatactgggtcagctgatagattacgttttgtgggctgtacgtttgaccacatagtgaatcctgtgtacttgcagaactttagtaactccgtagactttattggttgcggctttactggggaccgtgggtcagagtttacccgtataactccaagcaacctgtacattaataacgttggagatacatccgcgtgggttaattttatagactgtactataaataaccttaccagtgacggtatacgtaccggctctaacttacgcttatcagggggcactcgcttatgggggttggggtatgacgggactgttgagactcctaggaatggtgtatatgtcacagctaacaatgtaagcgtcgatgtatctgcgagtacgatagacgtatcggccggacaacatactcgctgtgtgttcgacggtggtatgtctgggtgtatgctgacagtaagcgctggtgccaagctcataggggcctccttagaagtgttccggtggaatggctccacgagtaaccgtgaggttctgtcggatgatgtctatgtacctggtacggttacggccaggggattcctaagcttctatagtcctagacaagtataccgctctgcgtcggcaccgactgtaggcaccttcgcgcgcggggagcgtgtactcaacatgagtccaaccgtactaggagctgcaggctcacagtatgtagttgagggttggttgaggctgacatctggggacacccatacaatgggagtagattggcttgaacttaaacaactaacggggagc

SEQ ID NO: 86 - protein, 779 aa, Artificial sequence
  specific to K66
MAFSWQESVKPAGTQDIQCDIEYLDKSYIHVYLDGAETTAFTWTSSTNIRLNSPLSAETAVLLIRKTEREYLYIEFASGAPFIEGNVDTQNMQLLHLAQELVEGRYIEGFYGDINMHRYRITNLGDPVDARDATNKQYVDTGDARLDARIDAEAATRKAADDALDTRVINLEQTYFNANTNSFSWWTVTTAPTSTITPGMLFTKAKVRLNGITQTAGYSYSVESGVITFAETVPAGTLVDVTIGIDTEADTSAVSAVLDLLASPQNNGAGVNVVHLTGAATVPFERFLADSGWNMDAAILAAAASGKTVLFRNDETYTISVNDIPFARYTSFIGNPGGNPPLFLITNPTGTYGTFNLYVANGLNGGRYNKFDNLSFRYPNQVKTGSAIPYPPLFAGGCYGSEFTNLDIGNAYIGFRLGGTLNSVELGAASRVRLSDIIGAPLYRGLSLEQVRDVPTIQNIRWNYNYLDGGPYAYDSTLKQWMHDNAWAFQFGRLDWSLVSNLFAYGYLRGVVLLSTRYTGSADRLRFVGCTFDHIVNPVYLQNFSNSVDFIGCGFTGDRGSEFTRITPSNLYINNVGDTSAWVNFIDCTINNLTSDGIRTGSNLRLSGGTRLWGLGYDGTVETPRNGVYVTANNVSVDVSASTIDVSAGQHTRCVFDGGMSGCMLTVSAGAKLIGASLEVFRWNGSTSNREVLSDDVYVPGTVTARGFLSFYSPRQVYRSASAPTVGTFARGERVLNMSPTVLGAAGSQYVVEGWLRLTSGDTHTMGVDWLELKQLTGS

SEQ ID NO: 87 - DNA, 1710 bp, Artificial sequence
  specific to K68
atgttaaacaatctgaatcagccgaaaggctcaaccattggtgtgctcagggatgggcgcactatccaacaggcattcgacgagattccggtaatatccgttctgcgcttcggggcaaaaggagacggggtcgctgacgactatccggctttccagagggcagcacttgaggctcagcgaattggaggggcggtaatcgacgtcccaacgccacctgtggagtacaagattgggttccctgtgttcctgttcgaccgcacttggttccgtggcacaggcattaactgtcgtgtgaactttacggacccgttgtatgctcgcaagagtcgtagcgggttcatcattggcagtggctacgagcagaaccgagacaaggccattcagtgccttaacgatggtacatgggccacgactgggtctgtggtaaactcagcgttcactgagcttcctcgtggacagtatgtgcgagacaacccgtcacaggttcagagtagactgtgtcgtgtttcggatatgtacctagtcgcaacgtaccctaatgggacaaccctgaagggtggctatgcggtgtctggtgccaacgctgtggatagcgatgtgttcaacatttggggtgagggctggaccgagattatcaactttggttctgacgttccgccagctactccaagctgtcacaacatgcacgcctacgatatcacgtgtgtcgagcctaaccattatgagacgtactatagtgcagggtttatggccaactccacgaactgcaccatcggtcgattccgtcagttaaaacctattgctgatggctcacctcacggttctggtggatcaatgaactacactgagttctgctcgttctatgacattgacatcccgagccttggccgcacagcctcctctgagggtatccttgtcaacaactcgaaaggagcggtcacccgtaatattcgcatcggtaacgctaagacctgtgtggctgagtattacaccactggggctggtatcttctacgaccaagctcacccgaacgtctttgatggaatccacgcgaacaactgcgacaacgctgtggcgctgcgctctaagttctccgtatggaagaacgttacgcagaccaattgtacgtaccatgtgtacttcggtacgactaacgcccagtcgtgtgttgttaagttcgtccctgactccatcgggttcggctctggtgttgatgggctggcgcgactccgcgataaccgtgttaatgggtacatcgagcgctccgtgtatgtccgtccgattaacttcctattggaagacaagacggtactccagagctgggacaccaacaggaacatgaaggctaagcctgacgtcggtttccatgtgctgtatccgattccggttaacatgcgagccattgtcagtgtaaaccagttcttaacgtttgaggtgggtgccgggtcaaaaggctccaacgtagacattaaggtgcgccgcatggcaacctttggtggtaacgcctctgagcagccaatcattgagttttctaactctaagactgccacagtggacaccgtacaggatactagcgtacaggccaacgcccctgcgcttgtcctcacggcgacacctgacatgcctaactctatggatgtcctcattacggtgagcaacccgaccattaacatgaacctcaaggagttccgactggtctaccttggggac

SEQ ID NO: 88 - protein, 570 aa, Artificial sequence
  specific to K68
MLNNLNQPKGSTIGVLRDGRTIQQAFDEIPVISVLRFGAKGDGVADDYPAFQRAALEAQRIGGAVIDVPTPPVEYKIGFPVFLFDRTWFRGTGINCRVNFTDPLYARKSRSGFIIGSGYEQNRDKAIQCLNDGTWATTGSVVNSAFTELPRGQYVRDNPSQVQSRLCRVSDMYLVATYPNGTTLKGGYAVSGANAVDSDVFNIWGEGWTEIINFGSDVPPATPSCHNMHAYDITCVEPNHYETYYSAGFMANSTNCTIGRFRQLKPIADGSPHGSGGSMNYTEFCSFYDIDIPSLGRTASSEGILVNNSKGAVTRNIRIGNAKTCVAEYYTTGAGIFYDQAHPNVFDGIHANNCDNAVALRSKFSVWKNVTQTNCTYHVYFGTTNAQSCVVKFVPDSIGFGSGVDGLARLRDNRVNGYIERSVYVRPINFLLEDKTVLQSWDTNRNMKAKPDVGFHVLYPIPVNMRAIVSVNQFLTFEVGAGSKGSNVDIKVRRMATFGGNASEQPIIEFSNSKTATVDTVQDTSVQANAPALVLTATPDMPNSMDVLITVSNPTINMNLKEFRLVYLGD

SEQ ID NO: 89 - DNA, 1785 bp, Artificial sequence
  specific to K72
atgtcagatatggacccgttgtatgaattgatgaaagactccgcggaggatatgtccggggctgcggttgaaatgaagggtctgatgacggctgatgataccgccgacatcaatattgaaggctatggcccgaaaccttcgttcagcaagcagattaaggaccgggtgcagccggaaatagaccggtttaacacctttatcgcatcttctgggtatgaggtaattggtgattacaccgccggcccgttgacgatcaccgaatacaaccagctcattcgctataacaacgagttgtataaactcacggcagcaaccgatatcccgtttaccacggcgggcaatactgacgaaacatgggccgacaccgacgctgcgcattttgtatctgtcggtgatgcagcgcttcgccaaaacctggcttcaggcgaaaaaggtatgggtggggatttggttcaggccaacgagacctacactgtcagtgatattcttcgccgcatgaggacgctaggggatgtcggcgcagggcgtccggtgtgggggtacgatacgactaatgatgtaaaaatatataacgcccaggctggtgagggcgcagatgacataatgatgaacggcgggtttttcctcgcccgaaaattccggggtaccagccgatttgcagtcgcatcgggtatccgtggggggcgtgcctcggttgatgactcaggggctttccgtgctcaggttgtatctgtatcgtcatcgttaggggtcgcaaattatggattacatgatggtgtatcagattatgcggatgcccttctccccgcccttgagccgtgggaaaccgtagcgtctgcgacctacaccgcaaacactgttaccatctccccggagacgtattctgaaaccctgaaaaacattctgaaaggcgacgtaatcaggacgaggcataccgaaagatactgggggacggtgcaatccgtaaacccgcaaatgggtgttattactgttgacatgtgggcactcagagacagccctaatttaacacctgcgaatgatggttcaggattctatgtgaacttcatcgacaaagtttgggcggataataaaaacgtcctcattctgccaaattcagccgggttatacgccaccgttggtgaatttggcgcactggtccagaaagcgggaatgggctacgtcaacggcatggatatggttctgctatcgggctctacgcaggatgcaacggccgcattcctggccaggagcggagcatccgggcatggttggctgtatgggtataatgctcagggaaaccgttttaacttctactcagactccggtgaggttacaccatacgcaggatacgtagaaaactcaaacgccatcgtcggtatgaaatttagaaataagaatacctactcgcaggcgtggtcaaactctacagacctaacggcggttaatccatctgcgctaacagcaataattggcccggcaggacatgttttccgcaggccagaaaggattcttactctgtccgcgagtggtatgctggaccagttttatccgactgtgtatgtgactgctgctggcatcaccatcacactaccggatatcactcagatgcctgtggctgggtacatttttaaggtcaggctgtttctggcaggaacctacatctttaatacctatcagggccagacaacaattgacggcaaccctcaacgcactgtaacaacaacatccgcccgtcaaaccattgaaattcagtttgatggtactttttggcagacatttctgagg

SEQ ID NO: 90 - protein, 595 aa, Artificial sequence
  specific to K72
MSDMDPLYELMKDSAEDMSGAAVEMKGLMTADDTADINIEGYGPKPSFSKQIKDRVQPEIDRFNTFIASSGYEVIGDYTAGPLTITEYNQLIRYNNELYKLTAATDIPFTTAGNTDETWADTDAAHFVSVGDAALRQNLASGEKGMGGDLVQANETYTVSDILRRMRTLGDVGAGRPVWGYDTTNDVKIYNAQAGEGADDIMMNGGFFLARKFRGTSRFAVASGIRGGRASVDDSGAFRAQVVSVSSSLGVANYGLHDGVSDYADALLPALEPWETVASATYTANTVTISPETYSETLKNILKGDVIRTRHTERYWGTVQSVNPQMGVITVDMWALRDSPNLTPANDGSGFYVNFIDKVWADNKNVLILPNSAGLYATVGEFGALVQKAGMGYVNGMDMVLLSGSTQDATAAFLARSGASGHGWLYGYNAQGNRFNFYSDSGEVTPYAGYVENSNAIVGMKFRNKNTYSQAWSNSTDLTAVNPSALTAIIGPAGHVFRRPERILTLSASGMLDQFYPTVYVTAAGITITLPDITQMPVAGYIFKVRLFLAGTYIFNTYQGQTTIDGNPQRTVTTTSARQTIEIQFDGTFWQTFLR

SEQ ID NO: 91 - DNA, 1914 bp, Artificial sequence
  specific to K82
atgcttaagaccgattttaaccagccgaaaggctcaaccattggtgtgctcaaggatggctccaccgttcagcaggcgttcgacaccctcggttataccgggggcttgctaggagaagcctctgtgcgtgctgtgcgacccaccgccaatggtcagcgcattatggccaacgtacagggagttctgtcacagtgggtttacgacgctggggacacagtaacggctgacaacgggtggttctgtctggtaaccccagagggacaccgttggattcgtgaggacggcatgttcggtatcgacatctctaagggattcgttcagggcaccgacctgagtaccaagtggcagcaggcagtagactattcagtgtacatggcggttacccgtaagaagactctgcgaagcgctacacctattcgactgcccactggcgagtgtaagatgaccaagactgttcgctgtccttcatggattggcaactttgtagatggcgcactctcagttgacctgtcagagctgccggataacgaggtggctttctggagtaaaggcgttcaggttaacggtctgtccacccaaggtgcgaccaccgatgtcctgtcggcctctaatggcatcaagttcaacggtaagggtcgagactttgggcagattgcaatcaaggttggtaacaccgcaaccgagtggactaaccaagggttcaacaatggtggttcacggttctatggtgtggccacttggaattgccacacgtccgtgttcctaacgaattacaacatgtacctagtcaagtttacaaacttcgacttcggcatcggtcaatatggtgtagtcttcgggacctacggtgaggtatccatgccagagcgagactccggtgagcgtattgagttcaacggcggtgtaatctatgggatgcgttacggtattcgattcggtatgaatgcggcctttgtggacattagtaatgtatcgttcgactacaccacgtatgacgtactgtctttcgctaataacaccatctacaacatgatcaccttaagtaaggttcacgttgaagcgactggtggttggatgattgctggcggtaacgctaacggaaacaacgtgattaacttggaccgagtggataacttgacgaccctcgttggtggcgcccaggttacagaaaccgagtctaacagtctgtgtcgccaaatgttcaacctgaatggcggcttcacgattaactgccacatgttcggtcagctcagtcctgcccagcagcctcacaaccctaggatctggctcaacgctgggacggctgcacgcatccgacagagtaacccatcgcctatggcagcagttcctcgtccgggttcaccggcggacttcttagcggcctacacgtttaacgactcgccattggggacgaccattgataacatcactacgttcaccctgacggagtcagtaaacgttgtgaaggccgacagtatcgttgtggatgttggtaacggccagcgtggtatcaagattgtcacgaacacagtgggtgcctcaggtgcctacgcagtggccttgacgactcctaagttccccgtggttggcaactcgaactacgcagcgatgctggcctatcagcctctattgactggcactgctggtagttacatctacacgtggacttggtacgacctcgacggaaacgtcatcagcaccgagaactacactgggtcagttacagcacagcgtagcgacaaggccatcattggttatgttgagccgggagtagtggaagacaagcgattcctcccagtctacgccgctactcgtatggctcctgcaaacgcagcgacagctaccatcacgtaccgtatggctcagaccgttggcgtgttcaacattgttaacctatacgcatggaggacctac

SEQ ID NO: 92 - protein, 638 aa, Artificial sequence
  specific to K82
MLKTDFNQPKGSTIGVLKDGSTVQQAFDTLGYTGGLLGEASVRAVRPTANGQRIMANVQGVLSQWVYDAGDTVTADNGWFCLVTPEGHRWIREDGMFGIDISKGFVQGTDLSTKWQQAVDYSVYMAVTRKKTLRSATPIRLPTGECKMTKTVRCPSWIGNFVDGALSVDLSELPDNEVAFWSKGVQVNGLSTQGATTDVLSASNGIKFNGKGRDFGQIAIKVGNTATEWTNQGFNNGGSRFYGVATWNCHTSVFLTNYNMYLVKFTNFDFGIGQYGVVFGTYGEVSMPERDSGERIEFNGGVIYGMRYGIRFGMNAAFVDISNVSFDYTTYDVLSFANNTIYNMITLSKVHVEATGGWMIAGGNANGNNVINLDRVDNLTTLVGGAQVTETESNSLCRQMFNLNGGFTINCHMFGQLSPAQQPHNPRIWLNAGTAARIRQSNPSPMAAVPRPGSPADFLAAYTFNDSPLGTTIDNITTFTLTESVNVVKADSIVVDVGNGQRGIKIVTNTVGASGAYAVALTTPKFPVVGNSNYAAMLAYQPLLTGTAGSYIYTWTWYDLDGNVISTENYTGSVTAQRSDKAIIGYVEPGVVEDKRFLPVYAATRMAPANAATATITYRMAQTVGVFNIVNLYAWRTY

SEQ ID NO: 93 - DNA, 2460 bp, Artificial sequence
  specific to KN1
atgatgaaccaagatattaaaacaatcattcagtaccctgtaggggacgtggagttcgacatcccgtttgattacctgtcccgcaagttcgtccgggtatacctcgtgtccccgctgaaccgccgccagctgaacaacatcactgaataccgatacgtgtcccgaacccgtataaaactattagtcgaaacagctggtttcaatttgatagagatcaggcgcttcacctctgcttccgagcgggtggtggacttttcggacggctccgttctccgcgcgaccgaccttaacgtctctcagctacagtcagcacacattgctgaggaggctcgtgatgccgctatgctaactatctccccggcagacgacggaagccttgacgcctccggtaaggtaatcaagaatgtaggcactcctgttcagagtagcgacgccgccactaaaggttatgtggataccgctgtttcgcctcttgcgacaaccattgaggccaacttcatgcgcactctacgaacatcaggaagatctatacgggaacttccgggtgcctcagaggtagctggtatgctcttaggttttaatggtgaaggtgacccggtcccagtggttgctggggaaggtactgcaagcgacgttatgttgaaactcgccggaacaactggactgtcctacatcggaggtgttgggtatgtaaccccagagatgatgacggtagatggtaagaccctcgtgcgcgggcttggtcaggaccatgtgcgcttcattcagaaagccattgatgagggtcatcgccggaatgttcctgtgatactatctggtgggtatgaggtctatgagacccttcatgatgccccgctacctcgtgatgacggcacagcgtatccagagtgggtggctaatggtggggactctaatatccgaccagaggagcagctctatcagaaggctcacttgcggttatataacaactcagtgattcttggggctggttcgcaaattgccaccatccgatcaacatgggctagaagtaccagtgccgttggcctaacctccccaattatgtggtacatcgagggaccgttggggaaccgtggcacagtgtcgtatgtactcaaaggaattaagactataggtgcatacatcggacgctacgttgtgggaatctcctacaggtcagtagaggatgacttagagttcgctggctgcggcatagcgggcgttaaacagggcgaggagcagaccattcaccggaagattgttatcactgcatacgcaggggatgtaacaggtgggtggtggcttcagcgcaataatgcgtatggtgctaagtacatgcctccgtacactgatacggatgtttggctgctggggtggtgtgatagctcaacatatgagtatctaagctacaccgggtatgactatgatgggcgagatgctcttgtgcatgactggatctcagagtggttcgacacctacatctttaagaccgccaactcccgtaaagtctcagagggtgggcgtctcacttatcagtcagctaacccatatccactgccgacactcaagggtataaccggaagggcgcggtacattacgtccagatactcccggcaaaatgctcttaacgtcatcaataccttaaagacactgataacgatacgagctccgggatacatggacaacagcacgcagtcttgtcgtatcttgaacgcgatgattgagtcggtcggtctcattcgcagaacttcaggcgcgaacgccggaaactacttcgggatcgatgtagttgacaagtggggagcagatactggggtgtggggtcttgagggtactggtatcctagagaagcaactagtcgtgttccttcgccccggtgtcccgtgcacaaacgcagtggtggctactggtgctggccagattttcgagagctggacaacaacaaacgcccagaggagactgttggcactccgtgattggaacccagcgactcaggttcagacgtacaggtatgatttccgcaccgattatgcccttatgcgacccactcggtactataccgacggtcctctgtggaactactctaaaggaacctccaccccgactgtagcagttaacgggtcgaccattgctgtacagaaagctgtgaccaactggtatcgacttggggacatcatgcgctgcaacatctacgtggagataaactccatcactctccaaggaaactcagaactcactgtgaccacgccgtcctttaacggctcgtgggaggttgctgggcagggcatcgggaaggtctacttatcgacgctaactgggggcgtgacgcttacccctgtaatccagcagggcggtaacgtggtgcgactccgtaagggttctagcccagaagtgtacgcttttgaggctggcacgtacaacaatgtagtgttaatcatcggaatcgactacgttcccttatca

SEQ ID NO: 94 - protein, 820 aa, Artificial sequence
  specific to KN1
MMNQDIKTIIQYPVGDVEFDIPFDYLSRKFVRVYLVSPLNRRQLNNITEYRYVSRTRIKLLVETAGFNLIEIRRFTSASERVVDFSDGSVLRATDLNVSQLQSAHIAEEARDAAMLTISPADDGSLDASGKVIKNVGTPVQSSDAATKGYVDTAVSPLATTIEANFMRTLRTSGRSIRELPGASEVAGMLLGFNGEGDPVPVVAGEGTASDVMLKLAGTTGLSYIGGVGYVTPEMMTVDGKTLVRGLGQDHVRFIQKAIDEGHRRNVPVILSGGYEVYETLHDAPLPRDDGTAYPEWVANGGDSNIRPEEQLYQKAHLRLYNNSVILGAGSQIATIRSTWARSTSAVGLTSPIMWYIEGPLGNRGTVSYVLKGIKTIGAYIGRYVVGISYRSVEDDLEFAGCGIAGVKQGEEQTIHRKIVITAYAGDVTGGWWLQRNNAYGAKYMPPYTDTDVWLLGWCDSSTYEYLSYTGYDYDGRDALVHDWISEWFDTYIFKTANSRKVSEGGRLTYQSANPYPLPTLKGITGRARYITSRYSRQNALNVINTLKTLITIRAPGYMDNSTQSCRILNAMIESVGLIRRTSGANAGNYFGIDVVDKWGADTGVWGLEGTGILEKQLVVFLRPGVPCTNAVVATGAGQIFESWTTTNAQRRLLALRDWNPATQVQTYRYDFRTDYALMRPTRYYTDGPLWNYSKGTSTPTVAVNGSTIAVQKAVTNWYRLGDIMRCNIYVEINSITLQGNSELTVTTPSFNGSWEVAGQGIGKVYLSTLTGGVTLTPVIQQGGNVVRLRKGSSPEVYAFEAGTYNNVVLIIGIDYVPLS

SEQ ID NO: 95 - DNA, 3735 bp, Artificial sequence
  specific to KN2
atggggtattttcaaatgaccagaaacgtagaagaaatcttcggtggggtagtcgtagcaccgcatcagatcccgttcaagtacacttcaacaaacggtggggaaactttcctttctttaccgttttatcctatcacagggtttgttactatcaactctggtgtacaggttccgattgataatttcgaaatcgacggaaatacattaaaccttggccgcgaactggaaccaggggatgtcgtattctgtttgttcgataaaatcatgtctcctcaggatgcgagcaacaatgcagttcgtatctacaaattcctttctgtcggtggtgaaactgaattcacacctgatttcacagcgtatggtgtgcagtctttgtacatagacgggaaatacaaaacgcccggcgaagattacaattatttcaaaacttccggtaaagttgttcttgatacagcgttgccaacaggtgtttgggtagttgctgagatgtctatcaagcaaaatattccggcgctggcgggtaacaatggtgcaagtgaaattggtacgaattccgggaaatccttagccgagtccttgggtacttggattgatactaccatcgcaatctttgaaatgaccgaagccccgtctgtcattcaaaccagaggtttttatgaaaccaatgatggtggtgccggagtatgggtggctacgggaattatatccccctctcttgcgggtacacatgttccatctcaggctaaagtttataatgccggaggtgtggagtatcagcttaacgtgaagtcgggttttgagatttccgctaaagccaacggggttaaggcagttgatgatgttaacgccgaaactgaggactttgtttgtctcggtgaggctataaacggtatcacctcacgtgtcaaaactatggtcaacgatgaagacctgaagacgtacttaaaagttattataccatccgagtacccattacgtattggtaaaaccagtatcaaggcgtactcccgcttgaagctagattttcagcaggcttcaatctacgaccggccaagcccgtcaaatcgtcaggaagtcaccggcgtttatatgaacgccattgagcgtggcattgaagatgtcagggctatctctgcaaggtttggtggcgcgacgtcttactcgaatatgactctctccgattttcatatcgaagggggtaagttctatggagaccataccactgataagggggttgcagattgcagcactggtacaggcctgtttacgtacaacatggaaaactccagtattcgtaacacatggttccagggatttgcttgcggtcgtcagtacaaccgtactggtcctggatattactttgataacttaggtaataaagtggttggaaccctggttcccgaagtaacctcatcaggtactggttcctacgaaggcgttaaggagtggtctgttactgcttatggctgccgctatttgtacctgcgagttcttagtaactgggcacggttcgataactgcaaattcggaacctacgctaactggtcttcaagccctgacggcaaccagtgtgaatacttcatcgagaaccgaggagctggtgtagtattcagcggcggagtaattgaggctaacacagcggctgccaacccaactaagggttttgtgagggattacgcgcgtgggtgtactttcgagggcgtctactacgaaaactgcctgtctgctgggtgggtaatagccatccccgaaaagagtcagtacaaccgagctaatggtctgttccttacggctatcgggagccagtttaccctgtcgtcgcaaggcgctcctctggttaaattcgaagaggggtactttggttcatataatcctgctacagggctgtataaaacaggcggttgggaaaccaattaccagtacgcaggtggggttaatacctgggctgtaggtcagcctgagctagattctggagctttccctcacggtgggtatgactttaaatatgggacttatggtattcactactctggaagtgtgccggatgcggattcgcttcgagacacccaagagggtaatgagtttctgtctccgtatgggttatcggttaactccgggattctgttattccctacgttatccccggcgtatcagtctaatatcgtagtttggtataaagacctgacagggaactttgacccaaggaatattgtcgttggtgatttcgacaataacaacgtgtctgatggtactagcaacgcactctaccgtactaatgggtttaattactatgactacggtaatgggtataaagcggctattgtcccttacgttaaccctcgtgctttagataacaggatgaccacatctgctggacggaagttaaaaatcaccgtaaccagtgatgcccctattatcctgaaaagcatccaggcatttgtagggggtactccaatattcccaccagccattaaggattatgtaccgcgttctcaacgggaccgcatttggggtactatgtctgctggttctacggattctggtgcatactatggcccactggttggcggcggtatcttccgacctggcgatgtagtgttaccctttgttccgttcggtaatgctgctctgatgaatccggcgtcatacacggataactcatcagggtttggggcaagtgcagagactgctgttattacaggaggggcaacatggggagcagggttagccggagcaacctttactcttactgtagaatcacaggatacaatcaataactggacaactgtttcagtgccgtccgcttatttaccgtatatcttcacaggtatgccggtttacataactgcaaactcctctggagggtctaccggattaataaacactgtacgcagggttgttaattctgatggaactctgagcaacaagtacgtgctgtatggtgctctgggggctgctggtacgaccttaacggtatcgacaacctcgagctacacagtacgctctggggtgtcctctaccctcactggagtctctggttcgttctctgctagctcgtggctgggtacggcatccggagatttacgtgtaggtttcggggcgtcaggttccggcacacgccaaactcgttactactacaacggcgcggatgtatcggctgtggttggttccagtggtgctaatgcgctgcacttaacgggtactggaggtatcaccctcaacgggtctttgctgacaagcactagctactcgtttggtagtgcctcggcatacccagcaaacatctattctcaaaatgctgtgaccgtagtatctgatgtgcactacaaaatggacatagtagagttaaacgatgcagagattgagtgtgctaaagcctgtgccaagttgtatcgtcgctataagttgaaaacagctgtagctataaaaggtgaagatggtgccagataccacgtgggaaccattgctcaacttgtgatgcaggcatttactgatgctgggttggactggactaagtacggaatcattacgtatgagtcctgggaagcttccgatgcagtcgttgaaactgtaggtgcggtctatgacgaagagggtaatgagttagttcctgaaacaatcatggtagttacccctgctaaagaggccggggaaatatacatggttcgctatgacgaatttaacagtttcgttatggcagggcaggaagccagacttcaggctttagaggagaag

SEQ ID NO: 96 - protein, 1245 aa, Artificial sequence
  specific to KN2
MGYFQMTRNVEEIFGGVVVAPHQIPFKYTSTNGGETFLSLPFYPITGFVTINSGVQVPIDNFEIDGNTLNLGRELEPGDVVFCLFDKIMSPQDASNNAVRIYKFLSVGGETEFTPDFTAYGVQSLYIDGKYKTPGEDYNYFKTSGKVVLDTALPTGVWVVAEMSIKQNIPALAGNNGASEIGTNSGKSLAESLGTWIDTTIAIFEMTEAPSVIQTRGFYETNDGGAGVWVATGIISPSLAGTHVPSQAKVYNAGGVEYQLNVKSGFEISAKANGVKAVDDVNAETEDFVCLGEAINGITSRVKTMVNDEDLKTYLKVIIPSEYPLRIGKTSIKAYSRLKLDFQQASIYDRPSPSNRQEVTGVYMNAIERGIEDVRAISARFGGATSYSNMTLSDFHIEGGKFYGDHTTDKGVADCSTGTGLFTYNMENSSIRNTWFQGFACGRQYNRTGPGYYFDNLGNKVVGTLVPEVTSSGTGSYEGVKEWSVTAYGCRYLYLRVLSNWARFDNCKFGTYANWSSSPDGNQCEYFIENRGAGVVFSGGVIEANTAAANPTKGFVRDYARGCTFEGVYYENCLSAGWVIAIPEKSQYNRANGLFLTAIGSQFTLSSQGAPLVKFEEGYFGSYNPATGLYKTGGWETNYQYAGGVNTWAVGQPELDSGAFPHGGYDFKYGTYGIHYSGSVPDADSLRDTQEGNEFLSPYGLSVNSGILLFPTLSPAYQSNIVVWYKDLTGNFDPRNIVVGDFDNNNVSDGTSNALYRTNGFNYYDYGNGYKAAIVPYVNPRALDNRMTTSAGRKLKITVTSDAPIILKSIQAFVGGTPIFPPAIKDYVPRSQRDRIWGTMSAGSTDSGAYYGPLVGGGIFRPGDVVLPFVPFGNAALMNPASYTDNSSGFGASAETAVITGGATWGAGLAGATFTLTVESQDTINNWTTVSVPSAYLPYIFTGMPVYITANSSGGSTGLINTVRRVVNSDGTLSNKYVLYGALGAAGTTLTVSTTSSYTVRSGVSSTLTGVSGSFSASSWLGTASGDLRVGFGASGSGTRQTRYYYNGADVSAVVGSSGANALHLTGTGGITLNGSLLTSTSYSFGSASAYPANIYSQNAVTVVSDVHYKMDIVELNDAEIECAKACAKLYRRYKLKTAVAIKGEDGARYHVGTIAQLVMQAFTDAGLDWTKYGIITYESWEASDAVVETVGAVYDEEGNELVPETIMVVTPAKEAGEIYMVRYDEFNSFVMAGQEARLQALEEK

SEQ ID NO: 97 - DNA, 43871 bp, Bacterophage NTUH-K2044-K1-1
ctcaccctcaacgcgcccaattgcccccatagggggtgcctagcgtcaatttaggggggggggggggcactagtggggcctactagtgcgcaccagggcgcctcagtgggcctgtgctgcgttctagggctatcgctagtgctaccctgtgcgtggcactgtgtggcccctgtgcgctctacgtggcactggggccatccctgtgcgctccctgtgggccataggggtgcgctctgccttgcttattttgtgcgcccattgcgggcctctagtgcctgtccagtgggccagctagtgcgctgtagtgctatccctagtgctatccctagtatgcactgggctatccactggctatccgtagtgctttacattgtgccgattatatgctacgctgcgcgctccccactagggcgcacttccacacccagcacactcagcacactcagcacactcagcacactcagcacactccagcgctatccaaatgctatccctttgctcttactttcattcgaaagctattatgaaatgaagttacaggagtaggaggggtttagggcactatacatactactactcactatgcactccctagtatgtccctgtgcctacgcagtaggctgacatacctacacagtcaccgcatcactccgtgcccttacactgcgtactggcactgcgttctgctctatgccgtattagatagtgttaggtagtattggctagatgtggctagtagtggctatccctagtatggctctaagttattgccctgcttaccctttttgctcttagggataaaagtttaaaaaaaaagtacttgcttcttttggttcaatagggctatagttcaatcaccgggaggcgctgaggcgctaaccggggccgagccgggaggctccgctggattaaagctagatagtgtgaagggttagatactcaataaaaagagttgacaccgcgaaggacataagctagattgaatcccgaagtaagcagtaaggtagtaagaaataaacgcttgacaagttctgattcactgagtaacttagatagcaagcagtaagctggtttgcggggaggcccagtaccttgaccggtacgttgacgaccgagcctatacaatcagcagtagtgaagatgtaacgtcaagagctgagacgacaaacggctggggcgctgaggcgctgccccataaaagaatagcgccgagaggttgagtcccttccacggttgtgcagtgggccgtactcacaggttagcagtcctgagccgataagtgcaaaggcagtcgctcccgtatccagtgagcgcggcaaatactgctggtatcctagcaaccacggagctaggggcgtttgagttaggttctaggcgggcaagtacattccgccagaatctaacccgtcaaacgttataaggagcactataatgaaatacaaagataaattgaaacaacaattcgaggggcttgagaagttatcaggccccgagttgagaaagcgccgggacgcattgaaccgcgccgggtatatgcggactaagcaatccgccacgttcagtacgagtgtacgcggcaagactaagaccaagggcagcagtaaagagcccaaaggttggtacactgtaaattcacaattaggggggttagtatgatgacattcttagcagtagttggcgcattctttcttgtcggcccgattcttcgattactgttcattatcctgttcgttagcaagaagtgaagagtttactaattacagcctatagcatcctatggggtgctatgtgaagtaattacctaaacaaccaatcaacgaggtgcattatgacccattcaactgataaagtattcaagctcaccgctgcgggcagcattcgcaaagcgcttggcgacgtagtggaagcaaagcgtaacatcactatcagtgcgctcttccacggcctgattagcagcaacgtctcatgggctacggatatgcagcgcagcgatgccgctgacttcgatatggtgctgcgtacgctgttaccaatcaagttcaacaaagagactcagcgctatgagttcgccgcgaagaagtgctatgcgtcggctgagaagttgggtattgagctggacacaatgcgtctggactataaacaagccaacaagcaggagcgcgaggttatcgtggccagcttctacagctcctgcatggccttgtacgccgctgaggcggagcaggtgaagaatgacgcgctggatgccgatgcagtgctcttgcaagcgctggggcgcgttaaaaacgctataaagaaggccaaagagactggcgtaagcgacgccgacctcgtgtctatgctggtatcgcagggcgtggatgtacgcgctgtgctgaatgcaactgaggtactcaaatgatgcacatcttcaagtgcaagtactgcggtagggtttactccggtgggcctaagcgctgccgccgccgtgattgtccgggtaatggtggaggcggcggcgcggctctggttatcaattggcgggccttgtgccctgcggccaacgatgctgacgccttcgatatccccacgcgggcaatcgctcaaaagtgggtgtatgagggattgggcgagtatctctagtagcaagcctatagcgtcctacggggcgctatgtgaatgcaaccggcgtatgaggtttcatatgaaagcaatactggtctatccgggccatgaactctggcccgtttggtgcaatcgggtatacgcagaatacaactacactgtggttatattctctgacaaagacactaatcaggaatcccctttaaagtttgtggatacctacaccgaaatggctgcccgcactgtgctggacgccgtgaatcttggcattatcaacgactggagacaactatatggttaatgtattcaacatcattgtgaccagcgctatgctggtgctgggcaacgacgtaaacaacccggtgccctattgcacagtgcagttgcagcaacccgcaacgcaagaaccgcagccgcgtccagcgtatgacctattcgaagaccccgagggcggttgtaaagagctgggcgcgcgtatccttgccgcggtgcaagagcaatacccggacgccgctgtaacgctcacggtggacggtaagagcaacaacgatatttgagggcaggatctatgaaagtattaaaattcatgcgtaaagcggaagcattacgtattgcggatgcaaatcccggcgctatcaagtacccgtattgcactggcaaatacaagccagtgcctgcgagatacctgggcgaagaggtcgaggtttccgatgatgtagtagctgtgtacgcagagcgccggtacgatagtttcgggccgtacactaaactcatgtgcgtgcgccttgtcgatgagggtgtggcatgagggcttatggaaagaatcctgaaacgctgctgatgcgtaagcagcaatcaacaatcgaagggctggcgcgggagtacagcgcgaaggcagcgctgcgccagcactatgagaaacaagcaaagcgcctgggtatgaccctgcgcggctactgccaacggtttaacgtgcggggtgtggtatgaagtacgacgtgtacctagagacctatagcggtctgtattatctcatccctgtggaaggggcaattaatgagcgtcgcatacttttaaccactgcgggattggtgcggagcagttaccgagcaggtgacgttatcacctctccggcttttgtattggtggcacgaaactgcgtgcctaagagaagcctatgctcacagtagacgaaaccgcgctgctgtgctggaagctgctggaaacacaaggcaagtgcgggtgcccgtgggaaacattcaaagaggttccagatgaactcaagcaaatcataccggtcgagcgtagactcctccgagttcgtaggcaggactctacggtggtactcaccacgtaccgtgagtatacagagtctgccgcgcggcagttgcaagaccacatcgaatttgatgtggtcgcggcgctgctacggcacggatatcgtggagcctatactagatttagggcggctgtgcgctcatattataagcaacgacaactcgctgcgtggtatgcacgctgagctattaatacacgacgcaatacaattaactcaggagcaaatgaaaatgcaagagaataacacagcacctatcgaatgggaagtagttttaccggaaggtgcaaacgcactgccgatgaaagagtcaatgtattctagtggtgattactggaccccgttccaggacttgcgaatgaagggagatgactacccccacactgagggcccgctgcaggcgcttatgggtctccgcactgtaagcgcgtacacccctggcttagaggtaactataggcggaatactgcaccctaagcatcgcgacgtaatgatgactcgcggcccactccaaaaggtggacctgtaccggtccgggactttctacgaactcttttccccagcgcgaatcaccatcgacaacaagttctgggaacgccgccgcgacttctacgagggcggggatgtagtggttgagcgcgtggttgcgtgcgtggaagagttcacaggttacaaggtgcacaagcaggctgtgcagttattcgagcgcattatgcttgcgccagaagagcagcagcgccgcttatacaccggctacgattacggtagccatatccgcgatggcaacgtagctgcgctgctcatgaagttgcacggtttcgtagtgtctagattcgccgtgcctttgggctttggtttccgcaacggtgagcccatcgttatgctggggcagccgcggatgcacaaggatttcgccgcagttactgagtaccgctgcgtagagatgcgcgtaggtaagtggctcgccaattactatggcaacggcgtagacttccgcgacgctatcgaagacctcaaggctatgaacgtagaccctacaacgtatctgtgcaagaccgagcaggagtggtacgatgcctatgagaacggcccgggtagctgcatgagcgggtacctctttgagcatagccctgtgcggacgtacgccaccaccagccacgggctgccagataacgggttgcgcctattcatccagtacaccggggagctgttcggtgacgatttcgaagtgcaggcacgggcaatcgttaacacagaaactaacgagtacgtccgtgcttacggcaacgctgctgatgcaaccctgcgagggcatgggtacaccagaaacactggctgtttggaaggtgtactgctggcgcgtataccgcaccctacctataccggcgcggtgctgatgccgtacctagatagcagccagcgcggcgtagatgagtatgaggaggatgcctttgtaatccgtgatgcttatgagtacgaggcgcaagactcagaaggatacatctacgtaggcactgagtctgctcggtgctgctgctgtgaatgtcgctactctgtagatgacatgcaggagaccgcagatggtgatatggtctgcgacggctgcgtagaagaaggggattttgtgtatgtagttgggcgtgatggtctgcatgatcgctggagctgcacttggtctgattaccacgacgcctatgtatatgacgcggacattgagcactgttcggtagaaggggtagtgcatgaccaagaagagctggtgtttgcacaggaccggcaggtgcttattgagcacgcagaagaacacccagtgcacgggttaattctcactgagcatgcagctgattgcctgggcgagaagtacctaggcaacgacgatgaagaagaagtagaggaggcagcttaatgttcttgaatccgcacgggattgatatgcagctgctcttgcagatactgcaaacgcaccggcctagctgggcgagcactaagtggtttgagccgctgcttatgcaggcgctgggtagtggtatgcactacgtaaaggacaagcacgggaactacttcgtgctggtgggagactcagagcaaagtgacgtagcgtttacgtctcatctcgacacagtggcgcgcccaaccagcgctgcgccggacgtcggctgcactaacaagggcgtactgttcgtaaagaatccgcagcaggctgactgtttgggcgcggactgcggtgccggtatctacctgatgctggagatgctgcgtcggggtgtgcatggacgctactgcttcttcgtggatgaggaggtaggttgcgagggtagcgctgcatcggtcaaggatgactctggattttggactggggtcaaggcgatgattagcttcgaccgccgcggcgacggtatcattacgcatcaaaggtatatgcgctgctgctctgacacctttgccaagaccctagcagagcgcctgggacgcgcggagcagcacttgcagaagggtgtgtatactgattcggctgagttcgttggcatcattcctgagtgcaccaacgtaggtgtagggtacatgcacgagcacaccccggatgaggtactggacctgaacatcctggggcaagtgcttgagcgggtactgcaagatggtacgttctcgcacctaccgattgagcgggaccctaaggtagtggaaccagaccaatggctctctgcgccaacgctcagtttacggcagccgtgggacatgccgccggacgaggacccgcaattgctggctgcgttccgtgtagtgtcacagctttctaaacagcaactggttagctgggtacaggagaacccagcgaaggcggcggagtacatcatggtgttctccgattatggattcaaagaagaactgattgaactaggcacccgagtcgtagaggactggggcggatacgataatattgtggagggttgattatgcaaaagtttaaagttggcgataaggttgtgcgtaaagagggtatgggtaaagataaattctttcaggacagtattggtggtagcatatactatgtagtgacgtccgtgagcaacgacggttactggctacagctagacgggtggtgtagtaaccgcaacacacacccttggtacgtgcttagttttgagctgtatcaagaacaagagaacgagctaccaccggttccggatggcgtgacctatatgaactctaaacgtgacccgggcaacgaccagcggcttgtcctagaaagatacagttatactgatgagaacctactctatataggaatagttcctaaaaagaaaagcacccgggcagagttggagattgggattaacatcgaccctgattcagccctgcagttggcacacgacctgcgtcgtatggctatgaaaataaaacgcgagcagaagtaatggaccagccctggcttagagcgtgcaagcgactggccgtggggcagagggcgcgctttcggtgctgcggcagggacgccgcaggggtgctctacaataacccggatgcctgggaatattattgccaccgctgtaaacatgtgggcaaggagcacaagcagtaccagcgcatacagttacaggaagagccgagggtgcagccctctgcacctgcagatgcaattcgcattagccaagcgcctgcggaaacgcagagttttatttacagattcctgactacaaagggaatcatgcctgaaatggtggaggatgcagaatggagcaaagagaaacagcggataatcttccgtgtcggaaacgctgctctgggccgtgcagtgcatgctcggcagcaaccgaagtgggtaatgtacggccagccaatagctttcgctgtcgcgacacctgccgtagcaccggctgtagctgcggccgcgcctctaaaggtcgtgctcaccgaggacttactctcagcccggaagatacagcacgcagttacgagctacagtgcgttgaacgtgcaggctatagctatgctgggtacacgcttgcccacaccgctgagggcttggctgattcagaatcgcccggaagtgattctgatgctggacaatgacccggcgggacacgctggggtagcggcagcacgtctggcactgcgcccgttcatgcagtgccgagagcattacttcgctgcggaccctaaggatgcagaaatcaaagagattctggaggctttacaatgagtatgggtatctgggttttaatcatggcgattaatggcagtgcggttagcgacacagacttcgctgcgctaaccactaaagagttcacgacggaggccgcctgcaacaaggcagccaaggcgttcgaagagaagtttgacacattcagggtgtataccgctaaagcaatctgcgttccgaaggaggtttaattggacctaatagttgttcgtgctatgtgcacgcagaaggtatggaaccgactgcgtgaacagatacccaagtccatgctagctccggacacagcgaacctactagactgggtggggttgtactggaacacgtacccggagcaccaggaggtgcagtgggacgcaatgcagagcatgctcaacctccgagctgggcacctatcccgggaagagcgggtaatcatggacgagcttatgcggggagtgcaggccgtaccacaggattctgtggtggggattgtccagaccctgaatgagctggcctacagtggggaggtagcagcgctgacacagcgctaccaagacggcgaggagattgattacctgctggagatgaagcacctgcagcgcaagtacggcgacggtgctgcagtgcacgagtcgctgcttgaatgggagagcggtagtgttgacgagatacttgccgcgactgatgagagcggcggtcttaaactgggcgtgttcgagcaactcgctagcaacatccgaggtctacgtggcggggactgtatcgcagtggctgctcctgtggactctggtaaaaccagtctgcttgctgctattgctgtggattttgctgagcaaatgcagcaacagccggaagtgtacggggaccgccctatcctctggctggttaacgagggcccggcgacgcgcacagtgccgcgggtatatcaagcggcgctgcactggactctggctgagattaaggaccggcacagtaagcaagagttcgtgccagcctacctcaagaaagtaggcagggctgaccggattcgtgttaaggctgcgcactccttgactatggcgcagatatccacgctcatggaggagatgcgccctgcggtaatcatcatcgacatggtggcgaacatccgtggcggcactatggagaccgagcaccagaacctcgaagcacgttggcaggagctgcgcatacttgggtgcgagaatgactgcgctatcgtaggcactatgcagctttcactcgaaggttacaacatgctgttcccgccgctcaccgctatgaagcagagcaagattggtgtacagggcgccttggacttggcgattatgatggggtgcttggacagaaacgagcagccgcacatgcaaaacgtccgcggtatcagtactccgaagaacaagatggcactgtctggtaaagagtcgctcctgcaattcgaggtgggattcgagcctggacgttgtagatttgacgaaggccagattaaccggtgacttccctagcgccttctatgagggcgctatgtaggtacacaggagggtttatgcaagtagactatacaggggttatccaaaaagtggattacacaggacttatacgcggtagttacgtggtgcgacaccgcgttacctgggaattttgtaccgtggaactcggggcacgctacaatcagagagagtgggatattgtagggcctatatcactgctgggagatttactagtatgcttaaaccgtcagacatcaactacctagacgacgaggtaatcaaggcgtacgctgcatctgcaggtactttccgtaaacgattcgcgctggacagcagccagctgattgtgcatctagctatcaacaaggctcggagggctaagtggaaatgactaccagtataatgcacattgacttggagacggagaaccatgaatattacggctctaaagcaagcccatactgccctgacaactatgttgttgagtcagcatggcgtatcgacacgacacaggctgacggtactaccactgttggcgcgactcaatcggtgcgcttcaattcaagagctgatttcttggcgggaaacagtgcagcagaaggctgccggtggtttcatatccccgaggattgctggcttattgttgcgcacaacgcagcctatgagatttcttggtttctcacgtaccaacggcagcagtttgaggccttcctcaagcgcggtggcagggtgttctgcacaatgcacggggaatacatcgcctcggactttcagagcatgtatccgtcactggacgagacggctcctaagtacggcggtacgcataaagtagacggcgtcaagattctatgggagcagggtgtgttaacctcccagattgacccgatgctgctgcacgactacctggttaacggggatatcccgaacacggccctgtgcttctacggccagtgtgctacgttcgcccagcgcgggcagatgcagtatgtgtgggagcgtatggatgccttgctggcttggacgtactgcgaatggttcggcctgttcgttaatatgcctattgctcgcaagaaccaagaggagcaggagcagcgcatccgtgagattaagcaggagctgcagcagtacatcccgaaggacttaccggagacactggatttcaacttcgggtcggacttccatatgtcagcactggtgtacggcgggcctatcaagtaccgcaagaaggtgccgtatgacccgccgcagtacgtcaaggccgacttctataagtacgaggacggagagggtgcgcacacctatatacctgtacacgacacgcacatgcaagaacttcaaacggaaggcggatggtggcgtgtagtgacatatcgtgcgggtaagaacaaggggctccccaaagtattccgcctcgatactgaggaagagaaacttaaatgggaagacgacctttacttctgcccgggcctggtgaacatccaggagcttccggaagttatccgggagaagtacgcagagcgcggagagttccgacaggcgcgtaccctgcaggacggtacgccagtatacagcaccagcactgacgcaatggaggcgctggctcgccaagggttcgagttctgtaagttagtgaacgagctggcggcgctggagaaggatactggcacttactatttgcgagaagtactggacgcagaaggtaaggtaaaagagcggaaggggatgctgcagtatgtaatcccggagcgtcccgatggttccggcatcattcaccaccgactgaatacttgcgccaccgtaaccgggcgcttgagtagctctaacccgaacctgcagaacctaccccgcccggatgaggatggcgacggagtggctaaatctaaggtgaagcaggtattcaccagtagattcggggacaacggacgtatcactgaggttgactactcggcactggaagtggttatgtcctgtgtacacacgggtgacaagaaactgctggggctgctgcagagtggtacggatatgcactgttaccgcctagctttccgcgaggaattaccatatgaagaagtatatgagcgctgccacaacaagaagcacgagctgcatccgctttggaaggcaatgcgtacaggtattaaggctcctagctttgcagcccagtatggcgctacggctaaggggattgcgtttgctactggatgtacggtggaatttgcacaggctttcttggacaacgaggctgcgctgttcccgcaaacaattggcttccgcgccgttgtcaaggaagaggtagaacgtaccggtgcggaggggcgcatgtaccgggagcaggctgacgacggcagctaccgaatctaccgcattgggacgtggaccagcccagccggtgcccgctacagtttccgccagaaagagcagtggaaggaagttgtgcccgggcagcgtaagcagaaggtaatggactacaaggaaactgagatggctaactactggtgtcagggggaagcattcttcctgatggcagtggcggccggtatggtcctgcgcgcactcctggcccgtgactggttcgacaatcaggtgtgcctgattacgaacgtacacgatgcattgtatctggacagcgccaacccggaggttggacgtgaggcgagcctgttggttaagcagtgcatggaggatgcacctaagcgtatccaccagctctggcctaactacggtatcattggtgaggtacccttcccagcggaagctgaaatgggtatgagcatgtacagtaaggagaaggtagaatgaatattaaaccaggcagcattgtggaattactggaacttgggcctgagccacttggtccagagttacggaagtacttcacacccggttcacagcaccgggttatctcttactgtaaagaaacttgggaggtagaactgatagaccctacgaatggctcagaagaacctggggatggtgttaccttcttcccgggggagtacaaacttatcgtggagtagtggtaggtgtacccttgggtggtgtagggtgttagggtagcacattataggggagaagtaaatagtgaaaacaaagttaggaattaaagccaccaggagaggcttaggtgttagggatgtattcttctactctgagtactacccaacactgctgctttataggaacagactggatgagcaggatagatttgtcccggtaggtatacaccgagcaaagtatctgcgctgtaattatgggtatgttcacgacatagtgtgggaatatcaccacgggcccaaaccaaagggcctatgggtggaccacataaacgggaacgggtgggataacagaattgcgaatcttcggctagtaacaccggcagagaacagggccaattacgacggttcaagaaaaccttttatacctgagtgtaaaaagtgttgactctggcttgattctgtgattcacagagaattaatgtgatacgagtaggaacaacataagagaggcaacccttggcaaagattagcttgattaaactgtggacgaaagaagaacaccagaagattcttggcaccttcttaaacaacaccgatgcagcgatagcttacaataacaagttcagaaagggggacgtgcttgtgtctcgccagcttgtccgctactggcgcagcatcttcatggataacgggggcagcaaggcaaaggctaacaacgccctgatgcaagcccgaaaactaatacaaccctccccaacggatgatattggggatacgtttgtacctgaaacctgtcgacgtgtactcgttatcggggacttgcacgagccttacacacacccggacgcgtatgactttttgcgcactgtgcgggatgagtactgcccagacattgtagtgcagataggtgacgagacagatggtcacgctatatcatttcacgatagcgatgccaacctagacagcgccggggtggaattagagaaggccaagcttggtcttgagaagctgcacaatctgtttcctaacctgctcctgtgcgactctaaccacggctcccttatctaccgaagggccaaggctcatgggctccctgtacagttcattaagaagtaccgggacatcctgttcccagagcacggcgcgccggggtggagttggggtgatgcttgggatttagagacgccgctgggtactgtgcgattccaacatcaagtatccggggacctgctgctcaacgcagcccatgaacgtaagtccatggtgattggacacttccatgggaagttagatatacagtatgccgctagcagcactgccctgtactttggtgcgcactgcggttgcttaatcgacaacaagagtctggcatttgcttacggcaagttgtcaagaagcaagccgattctagggtgtatggtgattacagatggatgcccacaaatcatccccatgctcatggatacttccggtcgttgggttggtagttctaaataacacagaggtaataatgaaaatgggaatttgttctgtactgggccttatctttgtaaccctgaaactgactggcgttatcgcttggtcctggctgtgggtgctgctcccgttctggggacctgcggtgctcgccgtaatcctggtgtttctggcggcctctgtggcctccatacgctaagccctgcatctgcacgtaaatatcatttaaactaaacgaggacgtaattatatgactatgaatgtactggcatccctgaacgccctggtagacgcagcaatcgaaacccaagatgtagatatgcgagaaaccgcacagggtggtgcgtacgaggatgtgctgctgccgaagggtgagtactacggctacttcaccgagtacgtggaaatcggtaagcgcctgccgaccaagggtggtaagcctaccggtaagcctgcagtggctaacgtacgtatcggcattgtagtgttcggccccaacggcgaagtgaagcgtatccgcccgtacccgatggctatcagtaactttgagcgagcaggcttcaagaagttcttcgacaagctcaactacgacaacagcattaagcatgcagcacagcgtctggggcaggccttcaccttcccgattgatgaacacaccagtgccgcaggcaagaagtctaacatcgtggacctgtccggtatccgcccgattcctaagttcgacccgaacaccggcgagcctatcaagatgccagccctggatgcctctgagattaagctgttcctgtggaacagcccaaccaaagagacctgggatagcctgcacatcgaaggcaccttcgacgacggtaagagcaagaactggattcaggaggatatgtacaaggccgtagacttcccgggcagtgctttggatattatgctgaacgctggttctgttccgagtccggcagctatgcaggcacctgctgctccctctgcaccggcggctcccgctgcaccacaagcaccggcagccccagctgcccctgcggctcctgcggctcctgtggcgccagtagcgcccgctgcgcctgctgcacctcaagcctaatctaccctaacctaaactaatatggccccgcatggggccttagaggaagcctatgaacatcattacgtgggtcaaagagcaatatgctgtgtttctgcttctgcgtgcacagcgtttgcagaagcgagcaaatgactggcactgggcggctaactctcacgcacacagggcaagccttctgggtaatgagattagtgtgtatcgctaccacctgactcgccagtgcgccaagtcccggcgccatgcatacgccttgggcgcaaaggctacggccaccgagaccaaagcccacaatttcatttcaaaacacaaactgaaaggatttgactaatggaccaagtactggatgcatacaagaatctggctatcgcagtcagtgctgtagtgtacgatgctgcggtgtacggggtacgcaccccccgcctaaacgacgtctatgacgctctggacaagctggccgccctgtatggcatggacctggagctggccgccactgccttcaaagagcacaatgacctggcggcgcatgcagataagttacgtggcgacgacctcgtgcttatccgcgttgtaggtaccctcagcatcgggctggctgagattggttcctgtatttacgatgcagaccagagtctacgtactccggaagtaatcggggacgtgctcggtaccgtgctggtgctgtctgagctgggggcttgacatgcacgtacgtataaaggtgtctgcacctagacacagctttatggcaccttatgctgaacatgcctgcaaccgctggtgcgtaacctttgtccgggaggacgaccctggcaccatgtatgtggtgcgctgggccgctaaacctacccgcaagcaggtgaagttggcagctaaatcagtagctagactggagatttaatgatgctgtacgtatctcgcgcaatttacgtagctttgattcttccactgattccgttggtgggactatgctacctgggcgacaagctcagcaaggcaaagtgggcagagcgttgggttaactgggccgccaagaaggcccgtgatattacggggcgctaatgattatcaacggggttgacttgtcccagctcggggagcagttagctccacagaactctgggaagattctgctgtatgacgcggatttcacagtttataaatctgccgctacagtaaaacgtttggacaccgcaatccgccgcttctatcagctgctgcttgaggacatgttcctggtcggttgctccgaggcagtggcgtatctgacacctgctggctgtgctaagtgcctgcgctggcacctgcctacggctaagccctaccagggtcagcgcgctaaccgtcaggagctaccgcttaaagcaccattgaagcggcacctgattgagaatcccgaccagtattctgagcagggcatccaggtggtcagcagtgactacttcgaggcggatgacctctttgtaatggattcgtacagcttcgggggccgaggaatcctgatgtcgcaggacaaggattcctggctcagccctatggcccggttcgatattccgaccggaaccgtgtggcctgccttggataacccattcggctggattaagtgggacgatacccaggctatgccggtacgggcacatggcactaagttcttctggtggcagatgctagcaggagatgacgcagataacgttaaaggcatcacattgcttgatgggaagctctgtgggaagcgaacggcctttgatgctatctaccctattacctcagagcaggacgccgcagaattcgttgtagcggcctatgctcgaaacaaccaagatgtactcgcagaggcagaatgcctattcctgcggcgctccccgtcagattctgcataccagtatctgatgtcactgttgactactcccagtctacgtgactgggtgcagtcgctgcacgagtaccataaacagcacatacagtggatacaggagcacccagacaatggcgaagatgtctgcgaaggaaatgagcctgcgggcgattgagttatactacgaggagaaacacgatgaacttgaaactattctggatgcgctgcgtgaacgagcacccaaaacacatcgaagaacggttgagcatttggattctctcattcacgacaatgctttgctggatgtagtaggggagattcaggtatggtagcgcgtcgtataactaggggtcaggtcagagccgtgaccttgaagctgctaaaagagcaaggggggctgtgcttaatctgtggcaagcctatagagttaacagctaaaagcacttccagggacggtccagcacttgaccattcacaccgtactgggcacatccgcggtgtgctgcatcggtcgtgtaacggaggtattggccgagcagagtctgtgataggacggtgggttacagggtccatgcaggacgaggccgctattgtagatgacatgcagcgcatggtagactatctacgcaagcctgagaccgagttaatttactatacacataaatcgccagaagaactggcacaggcacagaagctcaaggcccgcaaggcccgggcacgacgcaaagcacgggagattattaaatgagcgaagtcaaggttggggatgtggtgagacgttgggcacaataccgcacgctagattgggcagagttctgcatgggtctacgtgtggcttatggtgactcattcaccgttacagcggtgcttgatgggggcgtaatccttgatggttgtaacggccatctgtgggacccttgccactttgaggtggtcagcatatcaagtattcaggaaagtaagcctaaagcgcctgacgcagtaaactctccccagcactaccagttcttcccggacctggaagctatcgaggtgattgcacgcagtatgactcaggagcagttctacggctactgtttgggaaacagattaaaatacagactgcgcgcagggaacaaggataagctggggcaggacattgctaagtctgataagtacttagaactgtactaccagcacaaggggaagtgcattgacaccaagtgagtggtgccacggaatgtggcagaaagcagtagagcggggcgacgaaagctccgctaaagactacctggagatgtacaatctctgggtgcgtcgcaatcagtagttagaagtatcggacataaccaaggagactaagcgcctatgattagcgccctgaatacggttgtagtaccagaggaagcgctggtgaaacgccagctggagcttgaagagacctataagattcgcggaatcgagcgggcgcgtaagctgattacggacgcattgcagaacggtgggattatgaacctgccgatgacgcagcgtatgctcacctcagcatacgaggtggctgctgctgctatcgatgagatgcgaaatgtcaaagccccgggcattggcggcaagtatcgccggttcctgcgcttaatccccttggatgtcctgaccaccctgagtctgtgcacaatgtttgaggcgttcagcgtcgcccccggtgagtccgccagtcgccgccagactgcacaagcagtaatgtccgcattgggtaggaacgtacagtcagagctattggctctgcagttacgtaacgtagcccctgcgtacatggaccgtgtgtacgagtacctcactgagcgccgtacgaagtcaccttcgcacatcctgcgtacgctccgtgccagtgccgagaacgtgcactatgggcacgagccttggaccaatgcccagaacatctccgtagggcgtctgctgtgtgctgctgtgtttgagacgggtctgttccagtggaagacaggtagcgggaacctgagcatgctctaccccgcagacaacgttatggaagcattccagcagttagtggaatctgccgacactgtaacgatgaagccgcctatgctggtccccccggtgcagcacgccactatgtgggacggtgggtaccttactccaatagacaaccgaggtacgtaccataactcgcacatcgaccgcgccaggctgcgtgaagtagcggaagcatttaagtccgcggacggcatcaagaaggctcttaataaggcacaggaaaccccgtaccgtattaataagcgcatactggaactggtgcaagaagcacgggccatgggtattggggtgggtatgccccgctcagtgccggagccgaaacctgagtggtacttggacggagtaccaaaagagaactacaccgaggaggagcttgaccgcttcggtgagtggaagacgcgtatgtccctatggtacagcgcagaccgtaagcgcgtgtctcaactacgtagcctgttgaccacgctggaaatggcggaggaattcaaagatgagaaagctctgtacttcccaacctgtgtggattggcggtaccggttgtacttcaagtcctcgctgcaccctcaaggttctgatttgcagaaagcccttcttgagtttggtagaggaaaacctctgggtgatcgcggcttattctggctcaaggtgcatgtcgccacatgctttggttatgacaagaccctattcgaagaccgcgcagcttgggttgatgcgaactttgcagagattgagcagcttacagtttcaccgtttgattgccctgctttcacctccgcagacagcccttggtgcctattggccgccgctatcgacctggttaatgctgtgcgttctggatgcccagaagagcatattagccgaatcccagttgctatggacgctacaaactcaggtggacagcatctctcagcgctcctgagagaccctgtgggcggacgcttgacgaacctgtactgggagggtaatgataagaaagcggacctgtacatggacgtgaagcgccgtacggacgagaaggtgatactggacctggacaaggaggatttcattatccagagcacgtactggagagagaacgaaatcacccgcagcatgaccaagcgccctagtatgacctacttctacagcgccactgtgcgcagctgcagcgactacatctttgaaggcgcctgcgctgagggatacgagggtaccgagactaatagtctatggaacctgtcgtgctatctggcgccgcgtatgcgtaccgctatcgaggaggcaaaccccgctgctaccgcagttatgaggtacttgcagaacctcgctagacgcgtaccggcaagccagcatctgcagtggtatacgccgctgggtgggctcgtaatgaaccgctacacgcagcgtgaagaagtgcgcgtacgtattgactgcatgaacctgtcagcggtactggtacacaaccgggacttcaaaacttgcaacaagcgcaaggcagcctccgggattgccccgaactttgtgcatagcctggacagtacgcacttgatgatggtgctctgctctgcggaggggttggacattgtgcctattcacgactcgctggctactcacgcagctgacgttgacactatgcataggcacatccgtgagcagtttgtgcgtctatatgaagagaatgacctgcttggcgacattactcgcgcggcagcagcagccggggcagacttgacggacctggacatgccggaagtgggcactttggacatccggcaagtgctagaatccccgttcttcttttcatgagggtattatgcctaaacaactactgccgcatttagaggaaatacaacgccgctatacgtatgacccagagacaggtgcactgtgttggcgcataaaccagcgccgcgcaaaggcgggtagccccgccggaagtgtgtacagtaatggctatttaatggtgtacgtggccggacagcccaccctggcgcacagggttgcgtgggtcctggtcactggggaagagccgccggatgtgatagaccacgcggacaggaatcctctaaacaatgcttggaccaatttacgcgcatccagtatgcgtctaaaccaaggcaacaggacccctacaagaggtcgcaagctacccatgggcgtacgggagcaggggaacaagtacgctgcaaggatgacccaaagaggtgccagtatccatctaggcaccttcggtacaatacccgaggctgaggccgcataccgcaaagcaaaggccgaatacttctgctaaaaatttaatgttacaggagtaggaatgaagttaaaacacactagtaaaacttccgactacactctcaaggttctgtataaatctgacgacattacagacgcagtgaagcaactgcatgaactgggccacggcatttgtcggggcctggctccagagcagcactactggagggtactaggaagcatactgggtaaacagtatatactaggagtctatgactccaaaggcgacttagtcggtgctgtcagctactacccagaggctgtagaggactgtcattacgtagagcctgtgctgtatacagacttcttcgtattgaaaccggacaacggcgcggcagtgtctgtgattatgcggggcctgcacgcaatagccaagtgcatgcgtgctgggcgtatcgccattagccggagcacgtctagtaacacgtacaaaacaacttatcatttagtgaggtcagaatgagtggtggtttaggtaaactgttaggcaaggccacggatatgctaggccttactgacaacgcaggattagaggcgcagcagcgcttggcagagcagcaggccagcgcagcgaaacagcaggctgccttagaggctaatagcgccgcagataatattgctgagattgaccctgcaggggctgcctctgcatctgcagatgcaattacgtctgagcagaagaaacggcgacaagcagggcagagcaatcctctgggcctgtaagggggtagcttggaacaaaaagcaacattagcagaactctttaagaaggaccaggacgcaggcgtcttggatgcctctgagaagttcgcgcagtggacgctcagcactatctttaccagggacgattccctggacggtagacgcagaccgctagagcgtgactaccagagcaccggagcgcagctggtcaacactgcagccactaagattgtaggcgcactgttcccgcagggtaccagcttcttccggttctccaagagttcggacctggacgagttcattagttcgctgggtagtgcagctacagcagaatctaagctggccgaggtcgagaacacagcgtcacagaaagtatttgagaaagacggttatgctgcgaagttgcaagctgtgaagctgctgctggttacaggtaacgcgttggagtatattgatgagcggacaggtaaatccatcgtctactcagtccgtaactttaccgttcgaagggatggcagcgggaacgtcctgcgactcattatcagagagcgcgcaagcgtccaggacctgccagagagtttccagaacaccttctaccgtgacaaagacccatacggcgacgttgatatctacactgccgcttgtcgcaaggttaagcggacagaggacggtgcagatgtagtaagctacgaggtgtaccaagaagcagacgggcaccgtatcggggacagcagcacctacccggagctggagcttccttataacgtgctggtgtggaaccttgttagtggtgagcactacgggcgcggattggtagaggactacgccggggacttcgcccgattatctgtactgtcggaagcgctaactaactacgaggttgagtctgcgaggttaatcccgctgattgacgcaagctctgggttagacgtggacgagttctcaacgtcggagactggtgaggctgtgcaggtgggtggtggtggttccaacgggaacagcaaatcccccgtcactgcttacgagggtggctctgcccagaagattcagtggattgccagcaacatccagatgctcgaacagaaactgtcgcgcgcgtttatgtacaccggtaactcccggcagggtgagcgtgtcacggcttacgagattcgccagaatgccaaagaggcggaagccgctatgggtggtgggttcagtatcctgagtgacacctggctgcgtaaactggcgtacctgtacactgcactggtgtatcctcgctttaagctgtacctcagcgaaggtgtagtgagcatcaacgttacggttggtacttctgcactggctaaagccgcggcggcggacaagctgttagaggcggcacagtccatgcagctggccatcccggtgcttgagcagattaccccacgcttcaacaaagatgcgtgcgtagactggtacttcgacgcctacggtatcgtcagcgagccgttcatgtacacagaagagcagctgcagcagaagcaacaggttcaagatgcgtctgccgatgtatctgcaggtgcagcacaggaccaactccagggcttgacagcagcagacccgacagtagcaggtaagcagctgggcttattaccaagttaacaacagaggcatagatggataacgtagaaaacggtcagaacgtagaaactacacaggtagagaaccaaggcggccctaagattccgggcctaggtgctcccattagcgccccgaacaatcaaggcgtgcaggatgcacagacccctacccagcagcaacagggcaaagattcccctgaccctgctaagattcccctggatatcgaagccctaaaagcggcccttgataagggtggcgatagcgctaaggagcagccccaggagctagctaagacaggcaatccgacgattgatgccggggtagctatgttgcagaaagtctctgggttaactgactctgatatggtgcgggcacttggcaaggccctggagtatcaggaccctaacctaatcgatacggccttcattaaggaacgtttcggagagcacgctgcttatgcagagttgctggctaaagcgtacctggaagaccaggttggtcaagccaccaaggcagtacaggaagcttacgatattgtaggcgggaaggagaactggggggtagcagcgcagctgtttaattccaaggctcctgaacctcttcgtaacgcggctcgtgtactcgctaactcgggtgagcttaagcaggccgctgagttggtggcgagcttctgccgggatatgggtcttatcaagacacagaacccaatggtacgtggtgtagccagcaacaatgcactgtctgctgcggaattccgcgcagaatataccaaactccgtcaggaagcgggcaaccgtagcttggcgtctccgcagttcagtcaacgttataatgatttgctcgcacgccgtgaagctggtaagcgcgtaggtctttaattttatttataaaggaaactaaagcatggccaacactatttataatggcaacctgactcgtccgcactggggcggcgcggcgtctgacgtagacattcacctggaagtgtaccagaacgaagtggatacccgcttccagtaccaggctctgttcctgggcctctccagccagcgctctatcagcggttccaacacctaccgtattgaccgcctgaacacctcctctgtgaagggtcgtcgctccggtgaggcgctggatagcactccggtccgtaacgataagatgattatcgtggtggatacggtgctgtatatccgtaacccgatcgactaccaggatgactggaccggtccggacttcctgaccgagatgggtcagaacaacggctctgagttcgcggagaccttcgaccaggcgcacctgattcagctcatcaagggccgttcctgggttgctccggcgcacttgaaaccggcgttcaacgacggtatcgaggtaggcgcagctatcctggttccgggtaccacaaccgccacgcagctgacccaggctgagatggaggctaacgccatgaacatcaacctggcccacaaggctggtattgatgaactcatcaagcgcaagaccccgctggcggatatggtcactctggtggatgtcgatacctattcgcgtctgctggagcatccgaagctcctgaacatcgaattcggcccgtccaacaacgacggttacaaagaccgtcgtgtagtgaagatgaacggcgtgccggtagtagagtgcaccgagttcccgacctcggctggtacgcacccgctgggctctgcttacaccgtcaccgctgacgacgcgctgtgccgtatggtgactttcagcaagtccaagaccctggtgactgttgaagctaagccgttcacctcccgtatctgggacgatgagcgcgagttcagcaacgtactggactgctacgcgatgtacaacatcggcctgcgtcgtccggacaccgctgcagtgaccaagttcaccttcaccaccaagtcctaattggaggttcaatggcagtaatcgctacgttcggtctggagactctccaggccaatgcagctcagcgggaggcggttaaggccgccgctgatgccgcgaagaacatccaggtggcttcggttgagtctggccgcaaggctaccaagaaagcccgtaaggcggctgacgtagccgctgatgctacggaagagtagtacacgcacctggatagatgcatttttgaataggtagtataggtttatttataaggcagcctcgggctttcgtcttaatgcattatatcaaactataatgacactaaggccacgctccgccataaggtgataaaggcaaaagatactgaaagtgttaagcctaactaccgcgcccctggtgccttctggtgccgggggctttttttttgtgcttaaaggtgtaggtactggtgcgagcgcaatgccgttaaatgtgttccgattatgcaacctggactaaggttccgggcaatgttggtaacgggtaataggtcccccggtatgcggggtgaagtacagaaactcccagccagtacttgcacctttaatcataaaagagaggtataccctatgagggaattagatgccattaacttgacgctagaagccctgggggagtctcgcgttatggacgtcaatactagcaatcccagtgcggggttagcccgctctgcgcttgcacgcaaccgtcgcgggttactcagcacagggttctggtttaacgtggtagagcgcgaagttgctcccactgctgacggctttattaaagtgccatggaaccagttagctgtgtatgatgctggctccgactccaagtacggggtacgtgatgggaatctgtatgacctgatggagcagaaccaatacttcgacagttccgttaagctcaaaatagtcctggatttggactttgaggacctgccggagcatgcggctatgtgggtggctaactataccactgcacaggtgtacctcaacgacctaggtggtgatagtaactacgcgaattacgcgcaggaagctgagcgctataagagcatggtgttgcgcgagcacctgcgaaatcagaagttcagcaccagtaagactcgctttgcacgcagaatccgccgcgctcgttttatggtttaaggagaggttatggcacaaacacctatacgggcgttagaaggcacaattcagagcttgctgcaaggtgtttcccagcaggttccgagagagcgccaacctgggcaactaggggcgcagctgaatatgctcagcgacccagtttccggcatccgccgcaggcccccgggtgagattgtatgggagagcacaattgataatccagggcttgattccctattcacggaatacgtagagcgcggcactgacggtaggcacctgctgattaacaccagcaacggtaactggtggctgctggctaagaacgggaagactattcttaactccggcaacgacccgtacttcgttaccaccgtaggccagacatctttgcagaccgcaagcattgcagggttgacttatatcctgaatacggagatggcccctagcacaaccgtggacaatactgggcgtatcgaccccagcaccactgggttcttctacgttaaatctgcggcattccagaaacgttggaacgtcacagttacctctgcaggggtagattactccggggactacactgccccagctgctggcagcaccagtggtaacgctgaggaggtatctggtgcctatgttgcccagcaactgcgagattcccttgtggtgaacggtctgccagctgggaatgttagcgtacgcggcgcgtacctgttcttctatgggttgagcaactgcgtggtatcttctgacgctggggatacttacgcgggggtatccaaccagtctcgtgtagaccaggagcaggacctgccagcgcagctcccagcgcaagctgacggggcgatgtgtcgtgtaggtgcagcctcgtcagagacggcgtggtaccagtacagttacagcacacgcacctggtctgaggtgggggcatacggcagcatcaccaagattacgaacatgcccagagaacttgccgcggatgacaacattattgcgcgggattgggaggggcgcttagcgggcaatgacgataacaacagcaatcctgggttcgtcgagaacggctatatcactggtattgcagctttccagggccgcttggttctactcagcggcagctccgtggatatgtcggcctcgggcctgtatcagcgcttctaccgctctactgtgacttccctgctggatacagaccgtatcagcattagctctgcgtctgcgcaggattcggtgtaccgcacagctgtgcagttcaaccgggacctggtactattcgccaacagtatgcaggccgttgtaccgggctctgtggtgcttacacctactaacgcaagcattagcattaccagcacatacgagtgcgacagccgtgtgaccccggtcatggcggggcagacggtaatctaccccaacaagcgtaacgatagctacgccggtatactggagctaatcccatcaccatacactgcgtcgcagtatactacgcaggatgctactgtgcatctaccgcggtatatccccggtagggtgttgcagatgcaaaactccagtgtcaccaacatggccttctcgcgcctatccggggagcgtagtagccttctggtctacgagttcatgtggggcggaagtgatggtgctaaggtgcaggcagcatggcataaatggtcattcccgtatccaatcctgagcgtgcaggcactggaggatgaggtgttcttgtacatgcaaggacccagtcccagcaataagcttttgattgtgtctatggacccacgtgaaggttatcagttgggttcggagtaccgcgaagcgtactcggatttgcaaaagcaagttcaagtacaggacgggatatttaccgtgccggagattctgcggcccgtgggctggaccgacaactttcaggaagagcttattcttacgtacctcccaagcagtcctatgggccctactgaggtgggtattaaagagctggtgagcatcacctcattaagggtagtacgtggtgtacctgatggcacctacgtaatcggacgacgttaccgcagcacgtttacactaactacgcctattctgcgggaccagaatgacaagctcgtggggagtgggcacgtgcgcctgctacgcctggatgtagcggtgcgtaactctgggcacttcgatgtacaggtactagataccccacgggacgtaaactggggcggggaactaacaggtatcctgatgaactcaaaggagctgacgctagggcagaccctgcgtatggacctggctactattacagtgccatgccgtactaacgcagacacaaccgaggtgacgctatttactgaaggttctatggaactgaacgtgctggatatctcgtatatcctgcgctacaaccaacgcagacggagaatttaatatgggtatgtggtgggcagccgccgccctagcaggctctaaactgctaggtgctggggcgcagattgaggtatccaaggcacggaacaaggccgtaatccagcaaactgccaagcagctcaacgatattgcgctgcaacgcgcccagtccagggaccggactgaggtgtcgctgtttaacatccagcagcagaagctgcaggcccagagccaagtcggactgcaggcggcgtcttccggcactatgggggcgtcggttaaggatgccgtagccaccgttaacacggtagcgggacgtcaagaggccagtgtacgggaccagcaggcaactcaggaagaaggcttccgcatgctggtggataagactgttgattccggcctggcgaatatggatatggagagcggttatgacaagatgttcaacatggctctcagcgtaggcgggcagatgctcgggcagtacgtgggtaataagctatcagaaactacaccagaacctagcacagccagcgtggaaccaacggcgcagaactcgtttctgtacgacctgtggggcagcaagggcgatagcaaggttcacacctggtaaatagagagggaagtaaatgcctgtaattcaacccacccggcaggggcttaatattggtggagtacagctccaatccaatgaggtacaactaccctcttctgccggtgaagtagcagtagacgcaagcaaggccaaccgattagctgcgctgtccggattcgtacaggactttggcgtaggcttcgaggaaggaatcaaagagaacgccgcggccgccacagtgcgcggcgcgatggatgctcagggtgcagtggatgccatggcctccaaggatgaggctgtacagaagcagaacatcttcgtacgcgaagcctaccaggatggttacgtatcagctgcggcgtacgactcgctagccaagtggcgcacagacagtattgcacgggctaagaaagctgccgaggctgggctgactgacgaggagttccagcagcaggagcaagaacacgtccagtctatgtcggacaagcttggtatgtatctcccagagatgtccaagcagtctgctacggctgtgttgcagcagctccgtgctacgagcatggcgaactatacagccttccagaaaggtcgagctgcgtttgccgtggctcaggctgaccgcgcccttgaccgtggccttagctcgtccagtgatgagttctatcagcgcctacgggcaggacagggtgccgctgcgcagatgtctatcaagaccggcttagacagcatcctggctgctgagcacttggacaagagcaagaagctggaccgggccaaacagtatctggtcagcgtggcacagcagacgcaggacccgctggtaatcaaccagctgcaagagctagctaccaaggaactcggagttaactccgtggatgtcaacgcggccctgtatcaggagttcaagcgtgccggtgctcagattgagacccaggcccgttttgaaatctctgacgcaatctcttcattagaagggcagactcctgagcagcaagaacagacgatggcgcgtattcgtagtcgcgtcattgagctgtcggcgtcggacgttctaagcgctggaaccagcatggagttctggaacaaggcccagaccattcgcgagaaggcagcagacactcaggcattgcgcacagcgattactgggaatatgccaagctccactttggcgggaatgtacaagggcgacctgggtaaggcgcgcaatgagttgctcaagagctttccggatacctcggaagggaacctgcagctgctggcatacggaagcaatagcaaggatgcgtgggctgtcaacgaggcgcacaagcgtatgtcttcggacatggcgcgtacactgactacactggaccagctaggtgaggacggcgaggtttcccgtgagaacgtcaacagcatcaacttgtgggcacaggcttatagcaccagtacggacttaggtaagatggcgctactgtctgaggtaccttccgagtggcagggggtggtgcagaaagctattgcacaaaacccgagtaatgccagcgacactatcttggacgacctgcgccgccaggcgcgtaacaaggccagtgggcgctacagcaatatccagagtaaccccacggacaagatggtggaccctagcggtaccagcaactggttcagtttcttcggtgatgccgacgctcagcgccaggaagcgcgcgctgctatggaggaggagtaccgttatacgtacagccgcaatccagaatctctggtaggtaaggatgctgaggacatcaacacgatgctaaaaggcaacatccaagcccgtaagctagagctggaaattgccggtaaaccaaggcacgtgtatctgcctgcaggcgcctctctgcagtctatcatgggcgactacaagggcgaccaggaacagttcaaggctacgctgcaacagcagattcaaaaccaagtccaggctattactgaccccagcaacatggagcgtgtagtggtacaggctgccaccgcgggcaacgcaggtcagaacatgaccgtaaccgtgttcgacaagaagggcacattccagactatgtctgtgaacctccgcgacgttcaggctactgcgcaggctgcgtacgattcggcactggctggagagatgaagattggtagcgaacaagtaggtgtacgtcctgccaccttctacgaccatgacaacggacgtgctgtcagcgtgcaggtcaacggccgtaatgcggcggggctggagccatcgctgtttagtgatatcctcgccaccaccatgaagttcgaggggttccgagaaggcaagggcaagggtagcgtaggtttcggcctgcacgttaactctggcatgccggtccctcagaaagtaaccattgacgacggtatcagtatcctcaaatcctctatggagaagcagtacgttccgaacgtgcagaagcaactcaaggggcagggtttgaatgcctccgacgaggcgttaaaggttatggtggaccttaactatcatggtggtaacggtagctctggccccgtagcagaggcgatggcgcaggtacgcaaggctgctaagtccccggtgggggcgtatcagtaccctgtatctgaggcccagggtagggcttggcaagcgctgcggaataccccggcgtacaagcaggcccagcctgagcgtaagaagtacctggaacaaaacctacgtgattggctatttgaagcaacgcactaaccaggggcccttcggggcctccccttatcaaaattctttttaggagatattatggctcagtttctgaaccaagaaccgaatccacaggaaaaggattctgctaagggcgcaacacttaaacctgcgcccgcacgcgtagattggaatgatgccggggacaacggcctaaacgcactggagcgtgcctcgttactggcgcaggccaagacaccagctactacggccggggagagctttgcatcgggtatgggtaacagtatcgtgggggcagccatccgtaaagctttctctcccgcattcgaccaagacctgaactttgacgccaagcagactctgagcagtgacactcgcgctaagttgtatgcgccaaaccaggaagagattgagtacctgcacgattctgtatcggtcgaagattataactaccgaatgcagcaaatgcttgagcagcgtgaccgcgaccgcttaatggcggacaatacagtagctgggttcgctggtatgctggtaggcgactccccattcatcctggccccggtgtctgctgccggtattgctggacgcactggcctggccgtacgctccgctatccgtgctgctgacgtaggtacagcaatgtatgctcaggaccaactggggcaatctgccgcagtcacggcgctaattgccggggtggccggtctggaccaactctgggatatgtctagggccgccaaggctgctgccagggcccgtactgggcgtgagcctgcttttgacacggatgcgcctacaactcgtacagctagggacgctaatgttacaggagtaggagagggggaggatatcctcactagggcgctggatgagagtatcccggtatcccgtaataatactactgcagtgactgtgaaggcacagcacgtaattcagtttttgaaaacatctacgcacttgacagcaggccagaaggctattctggatactctgggagatgccgtaaacgacattgattttaaactggtggccggttcagcaaaccgtagccggtacacctattcccagagagatttagctttacgtggagaggtatcactgcgcgcacctaagagcgccaacggcactacgtgggagacggctggggacgcactgcgcgccatggacgcgggcactagtcgtgtagctgtgcatgagctgattcacgccgccaccgcgcgcgccgttgacagcaacccggagttggccaagcgtctggaggacgtacgcgctgctgtggctgctgacgctacgctgactgggcgtatgcgctattatgctagtgacgtgcacgagatgctggcgggactaggcgacagcccggagtgggtggagtacctagcgcgcacccaatctgctagcggtaagagcgtactacgccaggtcggggagtacatcatgaacgctctgggcatcaaggccaaaggctctgccttggaagatgtcctggatgcgtacgaggatgccgttaagtggacagctaaggattatgcagaccaagcccagagcttccgcagtgaagcctttcaggacctagcaggcagtactaccctcaacgaggctaagggtgctcaagctatgctggatggtgctaagagtaagtttgccactatgttctccttgtatgataatatcgcacaaggtaacgaagacttggctaaactgcttgtatcggatgctacggcagtaggcggacgtaagccatcagtagtagacttcaagcgcaacctcaccttagagatggacgcaagcgccagcatagtagaagatgctattattggagcgctgcgggaccgtggcgtaggtatgctctcacggttcttccaccgccagtctttcaggactgcacgtgctgagttagaaggccgtttaggtacatacctagattccgcgtatagtgccgaagttcatgggcgtcctgtgcctgtacccgatgcagagattgccccactggtagacgcataccgaaggtctgggtgggcgggtaagtggtacgaacatatgcgcgcagctggtttggttgacgatggggcgttggttaagtccgactactacttcccgcgccagtatagctacgacaagatgcgtcaaggtattatgcaaggcaacaccctggacgattaccgggccctgttccgctacgctctgcgggatgtatatcccagcatggaatccgaaacagtgcagcgcgttgctaaggagatggttgatggtatatacaatggccgtgctggacagtctggccctatgtggaggcagctgattaacggtatgggcaacgatgaggtcgttatggctatgcgcagcgctggtgtagatgagtctgcaatccagagcttcctaaccgctaacgtacgcgaatccggtagcacatcccctgcgcggaacctgcgccagcgtactcggttcaacatggacaaagagtatctggtgaatggtaagagcatgcgcatgcaggacctgatggatactgatgtagccaaggttatgcacgggtatactaaccgtatgtctgggcgtgtcggtatggcctacgccggtgtacaggacctggggcagttgggtaagatgattgatgaatctaagcataccctggctaatccagccaagtgggagaagactgtcaatgatactatcgactttatcctgggcggggcacccgctgatgcggggcagcttccggacctgctgcgcgcagctggtaatatggcgaacgccacgatgctcaagaactctgggctgtaccagataaccgacacagcattggctatgaaggaatttggtatgaccagggtcctgcggagtatgcgagaccagccttggttcaaagagggttctgtggctatcaatacccctgacatggcgtcacgcctggatgttgtgttgcgtggtaacatccagagggacatgcgcttccgctggctcaatacttacgccgacgacaatctggatttgacccgccaggcctcgtggttcaacgtcacccagaacgtgggtcaggcggcgcgccacgtcaacggcatgagtatggtgcaccggctgcaggttaacctgaattcaggtatcgtggcggatgagcttacgcagatgttcaaaggtgacgcagaggcgttcaagcggctggagcgttttggacttacccgcgaggttgctgaccgggccatcgctgccaacagggctaatcccggggctatgttccaaccggacctgcagatgcaagttgaggttgtaggtacacgcatgatggattatgtggtgcagcaggttcgcactggtgagacttcgcactttgcacagttcaatcctataggtaaacttattgttgggtaccagagctttgcactggcagctactaataagattctccgccgggagttgaatgacgcaggttggattggtgtagcccatatcatggcgtaccagttcccgttgatgctgttggctaccatggccaagcacagcatggacggcaaggattccgatactagcagactcattagtgaggctgctctgggtatgagcgcaatcgggggcatatccatgttgtcagctgcgttcttgggagacactccgaggcactccttagcatccatgagttatattacaggcgtattgggtgcgctacaaggattggccacaggggattcagacattaagaccttccttcgactggtcccgttaatccaggaattcgcacctacgcgagctatcattaataacttcggagacgactaatatggcattcagctggcaagaacaaatcaagccagctggtacccaggatatccagtgcgatattgagtatttggacaagtcctatattcatgtatacctagacggtgcggaaaccactgggtacacctggaccagcgctactaatatcaggctaaatacagccttggcagcaagcacgactgtgctgctaatccgtaagacagagcgagagtatctgtacatcgagttcgccagtggttctccgttcattgaggtaaacgtagactcccaaaacactcagttcttgcacctggcgcaagaactggtggagggtcgggctatccccggattctatggtactattagtatgaacgggtaccgtataacagacttagctaacccaattaacgcccaagatgctgccactaaggcgtatgtcgatactgcggataccctgctagggcaacgcattgatgcagagcattcggggtgggtgtctgctgtacatgcagaggctgttacacggaaggccgcagatgatgctttgagtatgcgcacctccgctctagagaacacctttataagcggtgtggaaacggtgagttacccgtggagtgcagtattaacagcggccacggacgaagtaaccccgggtctagccttcactaaggctgtagtggagattaacggggttgggcagattcggggttacagtttcgagattgtagataatactatactgtttgcagaggtcctgcctgcaggtactgttgtagctgccaggcttggagctgacgtaactgcaggggatggcttcgctacgcaagcatccgtagattacttagctaactcattgggagatttggcgtatctagacaaggctgcagctgtatctgatgcaacgagtaccggggatgtagtggctaaacttaatgccttgctggcagcgctacgcaccagcggggtgctggcaacgtaacaggagagaatatggcaggggcggctaaacgtagtcgtctctcggagctgcaccgaatgttcactgaggctttgattgaagaaatcaagcagtcgaaggaagatgaggtgccgctccccgccgcagataaatccgtcatcgctaagttcttgaaggacaacgacatcaccgcggacgcagattccgaggagatgcaggacctacgtgacgaattcgatgacgaactggcggcgcgcagagaggcgcgtaagaaagagattttaaacaagattagtggttcagactctgaggacttactagaaggaattgtctaatggtatcggtgaagactgcgcgaagactgcgcatgctcaaccagaaacttactggttatagtgcgaatccgcgcagtatccccaaagaggagcgcgaggatatcgcgatgatgatggccgccgctctaagcgacttccgggaatttgcgtacatcggtatgcggttcctgggctttacgctcacggacatgcaggccgacattgcagagtacatgcagaagggccctaggaagcgcatggtggccgcgcagcgtggtgaggctaagtctacactagctgcactgtacgccgtctggaggctcatccaggaccaatcctgccgtatcctgattgtgtcgggtgctgagaagcaggcgtcagacgtagctaacttaatcattcgtatgctggaaacctggccgctgctgtgctacttgaaggccgaccctactcgtggggaccgtacttcattcgaaggctatgatgtcaactgcgacctgaaaccgctggacaagtccgccagtgtggcctgtgtcggtataaccgcatccctgcaggggaaacgtgcggacctgttgattccggacgatatagaaaccaccaagaacggtttaacgcaaacccagcgtgagcagctgctgatgatttctaaagacttcgcagctatctgcacacacggggatacactatacctgggcacaccacagaccaaggacagtatctacaaaaccctgccgggacgtggcttcgaggtacgcgtgtggccggggcgcgttccgtctgttgaaatggaagagcgatatggaagtacacttgctccttatatccgggagcttattgagcgcggctataaacgcaccggcttcggcgtcgatgggacgctaggcgagagcacggacactgggcgctatgacgaggatgctctgattgagaaggagctggacttcggtcctgaaggcttccagctgcagtacatgctcgacactaccctgtccgaccagatgcgtacgcgtatcaagctttcggatatgctggtttactctggcagccaggactcctccccggagacgttctcctacatcgcggaccgccggtacctgtaccagcacgagcatgaggggattatgggccagcagatgtacttcccggcattctacggggacatgcacctgccataccagcataaggtgctggtggtggacccggctggttgtggcggagatgaagtgtcctacgctgctggaggcgctgctaactcgtacattcacctattctctgtaggcggcttccaaggaggtatcagcgaagagaacattgataaactgattgacctgtgcgtagagttggacatcccggatatggtggtggagagcaacatggggcacggtaccgtgtctatgcttatcctgaaccggctgcgggagcgacgtctctccggtatcggtgtacgggacctgaataactccacgcagaaagagcgtcgtatcatcgacacaatcagcccagttactcgtcgacaccgcctggtggtgcatgagcgtgctattcacgacgatattagcacctgtatggtatactcccgcgataggcgctggttgtactctgcgttcgcgcagttggctggtatcacgtacgaccgcggcagtctggctaaggatgaccgagcagacgcaatcgccatgatggtggctacgctgaacgggcacctggtggaagacgagaaagtggtggctgagagggagtctgagaagatggctcgggccttcattgagaacccgctggattgggcacagagcaaggtgtctaagggccttaggggcgtagccgctcggctgcagaaccggggcagaggtaaacaacatagaggaagaagataatggcatcaatcatcgcagctaaaactgcggacgtacagtacgccattgtaggcacgtgccagaacctggagaagcaggtgcagccggactacaacgtaggcttcgtaggtacgactgccctgactaagctgaacgagttcttcacgtacatgcagtcccagggctatacggctacccgtgccggtacagccttcaaggatgatggtacgctgcaggcgcgcctgttcagcatgctctcgcagctcgctaagaccggctacgtcgcccttacgggtacaggtatgccgctcggtgagggctccggtacagcgtttgatgattcgttcactgcactgcagagtgcattcgtagccgctactgacgcggcagcataaggagagtacacatggcaattgcaaaagcaaccccggcgcaacagcaggagctgctgcgtcagttgaacattctcggtaaggacctgtacgcaatccttacgcagccgcaggatgtggcccagactggcgctgccttcgataccaagattgctgcgcttgaagccgcggtagccgcagtgaaggctgctagctaatgcgtaaactggtcgctgggttactgctcgcggttactctgactggttgctcggcgacctctgcactcaccggcttagtgggttctaagccggatgtgtctgctcaggctggtgccgagaacaccaaacaaaccgttggcttgaataacaaggtggactccagcaccaccaacaaaaccgatgtatcaggttctaacgtaggcactttggatacgtccagtaagaagcaggtgcagactattagcaccgggacaatccaggcagagcgcctgcaggtggttaacaatgatagttacagtcttatcctcgccggattagctggggccagtattcctctggtcttcctagtggtcattctggtgattcgtaagctgttcaggaagaaggggcagcaggatgattaaggtgggagacatggttggggcagacctcgctacccgggcaggtgcagcagttaccggcgctacggtatcaggaggttggttggcagagttaatgagctggaactggagcactatcagcttcatcactgcgacggtgtgcgcggtgctaaccctggcgtggaatgcgtattacaagcgacgtacattcaagctcctagaggagcaggcacgtaaggggactattaaatatgagtttaaggactaaggttgtggcggccctcacgggggccaccatgcttggcggtgccattaccggcgtagtccagcacaacgagggcctgagccttgaagcctacaaggatagtgccggtgtccctacaatctgttatggggagacaaagggcgtcaagatgggccagagagccacgctgagcgattgtcagaagcaactgatacaatcagcaggggaacacgcaaaggcccttgacgggcttcctatgcagctctctgatgtagctctggttgggtctatagacttcatttataatgtaggcgtagctggcttcaacggtagtgccgtgaagcgccatctcaaaagcctgaactacgcagcggctgggaaggccgtgctggattggcgctatattagcaagtaccagcagaagtcccctggagttggttgggtatataagggcggcaatcgctggaccttcgactgttcccaatacattaacgggcaacgcaataaggtgtgctgggggttatgggagcgtaggcagtggcagagcaaggccattgggaaccagtataagaatgtaaatgctgcggtgacagctctcactaagaccggaggataaatggcattaattagattagtagctcccgagcgggtgttctccgacttggcgagcatggtagcatacccaaactttcaggtgcaggacaagattaccctgctgggcagtgccggtggggatttcacctttactactactgcgtcggtagtggataacggaaccgtgtttgctgtacccggtgggtacctgctacgtaaattcgtgggtccagcatacagctcctggttcagcaactggacgggcatagtcacgttcatgagcgcgcctaataggcacctggttgtggacacggtcctgcaggccacgagtgtgctcaacatcaaaagcaactctacgctagagtttaccgataccggaagaatcctaccggatgctgcggttgcacgccaagtgcttaatattaccggctcggcaccctcggtgttcgtaccgttagcagcggatgccgcggcgggcagtaaagtcattacggtggctgctggggctttgtctgcggtaaaaggtacgtacttgtatcttcgctctaacaagctgtgtgatggtggtcctaacacctatggtgtaaagatttcccagattaggaaagtggtgggggttagcacctccggtggcgtcaccagtattcggctggataaagcgctgcactataactactacctgtctgatgccgcggaagtaggtatcccgacaatggtggagaacgtaaccttagtatccccgtacatcaacgagttcggctacgacgacttgaaccggttctttactagcggtatctccgccaacttcgctgcggacttgcacatccaggacggggttattattggcaacaaacgcccgggggcttctgatatagaagggcgtagtgctatcaagttcaataactgcgtagacagcaccgttaagggcacgtgcttctacaacatcggatggtacggggtagaggtgctcggctgctcagaggacacggaagtacacgatatccacgccatggacgtacgccacgcaatctctctgaactggcagagcactgcagacggggacaaatggggagagcctatcgagttcttaggcgttaactgcgaagcctacagcacaacccaggctgggtttgatactcacgacattgggaagcgtgtgaagttcgttcgctgcgtttcgtacgacagtgctgacgatgggttccaagcgcgcactaacggggtggagtacttgaactgtcgagcttaccgcgcagctatggacgggttcgcttccaacaccggtgtagccttccctatctatagggagtgcctagcttatgacaacgtacgctctggctttaactgctcgtacggcggtggctacgtttatgactgtgaggctcacggtagccagaatggtgtgcgaatcaacgggggccgtgttaagggtggtcggtacacccgcaactccagctctcacatcttcgtcactaaggacgtagctgagacagcgcagacatccctggagattgatggcgtgagcatgcgctacgacggtaccgggagagctgtgtacttccacgggactgtgggcattgaccctaccctggtatctatgtccaataacgacatgaccggtcacggcttgttctgggcattgctgagcggctacaccgttcaacctacgcctccgcgcatgtccaggaacttactggatgacacaggtatccgtggagtggcaacgctggttgctggtgaggctacagtcaacgcccgtgtacgcggaaactttggcagcgtagctaactccttcaagtgggtgtctgaggttaagttgacgcggttgacctttccttctagtgcaggggccttgacggttactagcgtagcacagaaccaggatgtgcctacaccaaatccggacctaaacagcttcgtgattaggagtagtaacgcagcggatgtatcccaggtggcctgggaggtatatctctaagtagctctaagtagttctaagagctccccgggggtatctctacggtatcccggggtatcgcttgggcactcctggggtgcacgtctatacctggacctgaaatttattagactcacgcaaggatatgtctatgaacatcaaatatgacacaacatcccctagctgcttggtgtggctcaagggcagacgagccggagcggttgccggtacccgcaatactagtggctactgggtggtacaggtatctggtagaaagatacaggcacaccgcctcatctgggagctacacaatgggccgattccggacgggtacgtggtggaccacatcaaccaaaaccccggtgacaacagattagagaacctgcgcttagctacagttagtgaaaacaactgtaatgcacgcaggtctaagcgggagcatcctagaggtgtgtactataccggcacctgttggcgaggggagttctggaaggatggtaagcgtttcatgaagaagcacagctcctacgagattatctgcaagtgggtactagagaacagccaagagcagcacaaggccttcaccccggggcagatgtatatctgaactcgaaatttgttatactcacccttgggcctccctcaccctcaacgcgcccaattgcccccatagggggtgcctagcgtcaatttagggggggggggggcactagtggggcctactagtgcgcaccagggcgcctcagtgggcctgtgctgcgttctagggctatcgctagtgctaccctgtgcgtggcactgtgtggcccctgtgcgctctacgtggcactggggccatccctgtgcgctccctgtgggccataggggtgcgctc

SEQ ID NO: 98 - DNA, 43365 bp, Bacteriophage A4528-K2-1
cctcaccctcaacgcgcccaattgcccccatagggggtgcctagcgtcaatttaggggggggggggcactgggtggggcatgctagggccagctagtgcgcaccagcgggcctcagtggctctctgcgctgcgctagggctatcgccagtgctaccctatggctatccctgtgcgttcactagggcgcctcctgtgcgctctctgtgggccataggggtgcgctctgccttgcttattttgtggggccgtagtacgtgtccagtgggcctgcctagtgcctgcccagtgtgccagtagtggggccacagtgggccagctagtgcgctgtagtgctatccctagtacatactaggctatcgctagggctatccatagtgctttacattgtgccgattatgtgctacgctgcgcgctccccactagggcgcacttccacactccagcgctatcccaatgctatccctttgctcttactttcattcgaaagctattatgaaatgaagtaaccggagtaggaggggtttagggacactatatacactactactcactatgcactcactagtactcactagtatgtccctgtgcctacgcagtaggctgacatacctacacagtcaccgcatcactccgtgtccttacactgcgtacggacactgcgttctgctttatgtagtattagatagtgttaggtagtattggctagtagtggttacagctattgcctgcatagtgctatccctgcgctatccctagattggtttagcatggtaagtgcatgacctgcttaccctttttgctcttagggataaatatttgcaaaaagtacttgcttcttttggttcaatggggctatagttcaatcaccgggaggcgctgaggtgctaaccggggccgagccgggaggctccgctggattaaagctagatagtgtgaagggttagacactcgataaaaagagttgacaccgcgaagaacataagctagattgaatcccgaagcaagtagtacagagtaagcagtaaggcagtaagaaataaacgcttgacaagttcggattcactgagtaacttagatagcgaacaacgtagtaagctggtttgcggggaggcccagcaccttgactggtgcaatgacgaccaatcctagacaatcagtagtagtaaagatgtaacgtcaagagctgagacgacaaacggctggggcgctgaggcgctgccccttaaaagaatagcgccgagacctgaaccacaggttccacggtagtgcagtgggtaacaaggttaagagttagcgtcctgctaaataccgctagggcgttaatcattaactttgaggtgcaatatgaaatacagagataagttgaaacaacaattcgaggggcttgagaagctatccggttcggaattgagaaagcgccgggatgcactgaaccgcgcagggtatatgcggacaaagcaatccgctacattcagtacgaatgtacgcggtaagaccaaaacaaagggcagcagcaaggctccgcaaggttggtacactgccggacaattcggacgttaattacagcctatagcatcctatggggtgctatgtgaagtaattcgataagtaaacaaccaacaataaacgaggtgcattatgactcattcaactggtaaagtattcaagctcaccgctgcgggcagcattcgcaaagcgcttggcgacgtagtggaagcaaagcgtaatatcactatcagcgcgctgtttcacggcctgattagcagcaacgtctcatgggctacggatatgcagcgcagtgatgccgccgacttcgatatggtgctgcgcactctgctgcctatcaagttcaataaagagtccggtaagtacgagttcaatgcgaagaagtgctacgcctcggccgagaagctgggcatcgaactggacactatgcgtctggactacaaacaagctgacaagcagggccgcgaggttatcgtagccagcttttatagctcctgtatggccctgtacgccgccgaagcggagcaggtgaagaatgacgcactggatgccgatgcagtgcgcctgcaagcgctggggcgcgttaaaaacgctatcaagaaggccaaagagactggtgtaagcgatgctgaccttgtgtctatgctcgtatcgcagggcgtggatgtacgcgctgtactggacgcgacgttgaaggccgcggcatgatttataaagtaccggttatcaagtggtgggccttgtgccctgcggccaacgattccgacgccttcgatatccctatgcgggcaatcgctcaaaaatgggtgtacgagggattgggtgagtacgtatagtagcaagcctatagcgtcctacggggcgctatgtgaatgcaactagcgtatgaggtttcatatgaaagctatattggtttgtccgggccatgaactctggcccgtgtggtgcaatcgggtctacgaggaatacaactacactgtggttatattctctgacaaagacactaatcaggaatcccctttagaatttgtggatacctacaccgaaatggctgcccgcactgtgctgggcgccgtgaatcttggcattatcaacgactggagacaactttatggttaacgtgttcaacatcattgtgaccagcgctatgctggtgctgggcaatgacgtaaacaacccggtgccctattgcacagtgcagttgcagcaaccggcaacgcaagaaccgcagccgcgccccgagtacgacctatttgaggacccggacggcggctgcaaagagctgggcgcgcgtatccttgcggcggtgcaggagcagtacccggacgcctcggtgacactcactgtggacggtaagagcaacaacgatatttgaggtgttaacgtatatgaaagtcttaaagttcattcgtaaatcggaggcactacgcattgcggatgcaaaccccgactcgatcaagtacccgtattgcactggaaagtacaagtccttgccttcaagatacttgggcgaagaggccaaggtttccgatgacgtactggctgtgtatgcagagcgacgctatgatagttttgggccgtacactaagctcatgtgcgtgcgccgtgtcggtgagggtgcggcatgaaggcttacggaaagaatcctgagacgctgctgatgcgtaagcagcaaccaacaatcgaagggttggcgcgggagtacagcgcgaaggcagcactgcgccagcactatgagaaacaagcgcagcgcctgggtatgaccctgcgcggatattgctaccggtttaatgtgcggggtgtaatatgattaagtatgacgtatacaacctgcgcgggacgtactaccgtatagcggttgacgcaccactaactaacccggcggagtggtacagttcatatcttggtgtgtacttgaaagactgtgcatttgatggcatgtttgtattgctgtacagtcagtccgtactcgtggcccgcaacgtggtattcaaggacagcgtatgctaacagtagacgaaacagcgctgctgtgctgggccctgctggaaacgcagggcaagtgcggctgcacttgggaaacattcaaagaggtccctaatgaactcaagcaaatcgtaccggtcgagcgtagactcctccgagttcgtaagcaggactcaacggtggtgctcaccacgtaccgggagtatacagaatctgccgcgcggaagttgcaagagcagatcgaattggatgtggttacagcactactacggtacggatatcgtggagcctatacaagatttagggcggctgtgcgctcgtatcataagcaaagacagctcgctgcgcggtacgcacgctgacttagcagtcaacgacgaactcgttgaatctattcaggagcaaattaaaatgcaaactaatccggctggcatcccgtggaaaatcgtattaccggaaggtgcaaacgcactgccaatgaaagaatcaatgtattccagcggtgattactggaccccgttccaggacttgcaaatgctgggcgctgaccatccccacactgagggcccgctgcaggcacttatgggtctccgtactgttagcgcgtacaccccgggattagaggtaactataggcgggatactgcacccagagtatcacgaagtaatgatgactcgcggcccgttgcaaaaggtggacttgtaccggtctggaactttctacgaactcttttccccggcgcgaatcaccatcgacagcaagttctgggagcgccgccgcgacttctacgagggcggggatgtagtggttgggcgcgtagttgcttctgtcgaagagttcacaggttacaaggtgcacaagcaggctgtgcagttattcgagcgcattatgcttgcgccagaagagcagcagcgccgcttatacactggctacgattacggtagccatatccgcgatggcaacgtagctgcgctgctcatgaagttgcacggtttcgtagtgtctagattcgccgtgcctttgggctttggtttccgcaatggtgagcctatcgtgatgctgggacagccgcgcatgcacaagtacctcgccgcagttactgagtaccgctgtgtagagatgcgtgtaggtaagtggctagctaactactacggcaacggcgtagacttccgcgatgctatcgaagacctcaaggctatgaacgtagatcctacaacgtacctgtgcaagaccgagcaggagtggtacgatgcctatgagaatggcccgagtagctgcatgagcgggtactcatttgagcacagccctgtgcggacgtacgctaccaccagccacgggctgccggataatgggctgcgcctgttcatccagtacaccggggagctgttcggtgacgatttcgaagtgcaggcacgagcaatcgttaacactgagactaacgagtacgtccgtgcttacggtaatgcttcggatgcaatcctgcgcggtcatggttacaccagaaacactggctgtttggaaggtgtactgctggcgcgtataccgcaccctacctataccggcgcggtgctgatgccgtacctagacagcgaccagtgcggtgttgatgaagaagggagtgacgcctttttggttcgtgacgcctacgaatacggggcgcaagaaccagaagggtacatctacgtcggtacagaatctgcccggtgctgctgctgcgaagggcgcttctccgtcgatgatatgcacgaaaccgcagagggtgatatggtgtgcgatggttgtgttgatggtggggattttgtgcacgtagttgggcgcgagggtctgcataatcgctggggatgcacgtggtcagagtaccacgatgcctatgtatacgactgggatattgagtactgcgcagtagagggtgtcgtgcacgaccaagaagagctagtgtttgcgcaggaccggcaggtgctcattgagcacgcagaagaacacccagtgcatgggttaattctcactgagtatgcagctgattgcttgggagagaagtatctgggcaacgatgacgaagaagaagtagaggaggcagcttaatgttcttgaatccgcatgggattgatatgcagctgctcttgcagatactgcgaacgcaccggcctagctgggcaagcactaagtggtttgagccgctgcttatgcaggcgctgggtagtggtatgcactacgtaaaggacaggcacgggaactacttcgtgctggtgggggactcagagcaaagtgacgtagcgtttacgtctcatctcgacacagtggcgcgcgcaaccagcgctgcgccggacgtcggctgcactaacaagggcgtactgttcgtaaagaatccgcagcaggctgactgcttgggcgccgactgcggcgccggtatctacctgatgctggagatgttgcggcggggtgtgcacggacgctactgcttcttcgtggatgaagaggtaggctgcgagggcagcgctgcatcggtcaaggacgacaccgggttttggactggtgtcaaggcaatgattagcttcgaccgacgcggcgacggaatcattacgcaccaacggtatatgcgctgctgctctgacacctttgccaagaccctagcagagcgcctgggacgcacggagcagcacttacagaagggtgtgtacactgactcagccgagttcgttggcatcattcctgagtgcaccaacgtcggtgtagggtacatgcacgagcacaccccggatgaggtactggacctgaacatcctggggcaagtgcttgagcgggtactgcaagatggtacgttctcgcacctgccgattgagcgggaccctaaggtagtggaaccagaccaatggctctctgcatctacgctcagtttgcggcagccgtgggacatgcccccggacgaggacccgcaattgctggctgcgttccgcgtagtgtcacagctttctaaacaacaacttgttagctgggtgcaggagaacccagagaaggcggcggagtacatcatggtgttctccgattacggcttcaaagaagaactgattgaactgggcacccgagtagtagaagactggggcgggtacgataatattgtggagggttgattatgtctaagtttaaagttggtgataaggttgttcgcaaagcacacaaaaaccattcgtcgtttaagtcgtacatgggcgattttgcttactacgtaattacagatataactacaagcggccactagctgcagttggataactttacagatggaggagccgacccctacccgtggtacgccgataacttcgagctgtatcaagaaccgaaggatgagctgccaccggtcccggacaaggtggcctacatgaactccaagcgcgaccctggaaatgaccagcgcctagttcttgagaaggataacggggatggggaaggtttaatgtacatcggggtagttcctaagaagggaagcactcgggaaaaggttgagattgggattaacatcgaccccgattcagccctgcagttggcccactacctgcgccgcatggctatggaaatcaaacgtaaggggaaagcacaatgagtagaattattaagtacgaagcgcctaagagtgttgtagtcggcatcccattcacctggggattgtgtaatgcttgggctataaaggtggagaatggggacatctactatttatctaatgggtcaaaggtattagagtcagaagaagagatactcccagacatcatttatgccaatcacatagagattaagtaatggaccagccctggcttagagcgtgcaagcgcttagccgtggggcagagggcacgctttaggtgctgcggcagggacgccgccggggtgctatacaataacccggatgcctgggaatattactgccaccgctgtaaacaggtgggcaaggagcacaagcagtaccagcgcatacagttacaggaagagccgagggtgcagccctctgcacctgcagatgcaatttgcattagccaagcgcctgcggaaacgcagagttttctttacggattcctgaccacaaagggaatcatgcctgaaatggtggaggatgcagaatggagcaaagagaaacagcggataatcttccgtgtcggaagcgctgctctgggccgtgcagtgcatgccaggcagcagccgaagtgggtaatgtacggccagccaatagctttcgctgtcgcggcacctgccgtagcaccggctgtagctgcggccgcacctctaaaggtcgtgctcaccgaggacttactctcagcccggaagatacagcacgcaattacgagctacagtgcgttgaacgtgcaggctatagctatgctgggtacacgcttgcccacgccgctgagggcttggctgattcagaatcgcccggaagtggttctgatgctggacaatgaccctgcggggcacgccggggtagcggcggcgcggcgggcattacgcccgttcatgcagtgtcgggagcattacttcgctgcggacccgaaggacgcagaaataaaagagattctggaggctttacaatgagtatgggtatctgggttttaatcatggcgattaatggcagtgcggttagcgacacagacttcgccgcgctaaccactcaagagttcacaacggaggccgcctgcaacaaggcggccaaggcgttcgaagagaagtttgacacattcagggtgtataccgctaaagcaatctgcgttccgaaggaggtttaattggacctaatagtagttaaagcgatgtgcacgcagaaggtgtggaaccgactgcgtgaacagatacccaagtccatgctcgcgccggatacgtcgaaccttctggactgggtggggttgtactggaacacgtacccggagcaccaggaggtgcaatgggatgcgatgcagagcatgctcaacctccgggctgggcacttgtcccgggaagagcgggtaatcatggacgagcttatgcggggagtacaagccgtgccacaggattctgtggtggggattgtccagaccctgaatgagctggcctacagcggggaggtggcggcgcttacgcagcgctaccaagacggcgaggagattgattacctgctggaaatgaagcacctacagcgcaagtacggtgacggcgctgcggtgcatgattcgctgcttgaatgggagagcggtagtgttgacgaaatacttgccgcgactgacgagagcggcggtcttaaactgggcgtgttcgagcaactcgctagcaacatccgaggtctacgtggcggggactgtatcgcagtggctgctcctgtggactctggtaaaactagtctgcttgctgctattgctgtggattttgctgagcaaatgcagcagcagccggaagtgtacgggggccgccctatcctctggctggttaacgagggtccggcgacgcgcacagtgccgcgggtatatcaagcggcgctgcactggactctggctgagattaaggaccggcacagtaagcaagagttcgtgccagcctacctcaagaaagtaggcagagctgaccggattcgtgttaaggctgcgcactccttgactatggcgcagatatccacgctcatggaggagatgcgccctgctgtaatcatcatcgacatggtggcgaacatccgtggcggcactatggagaccgagcaccagaacctcgaagcgaaatggcaggagctgcgcatacttgggtgcgagaatgactgcgctatagtaggcactatgcagctttcactcgaaggttacaacatgctgttcccgccgctcaccgctatgaagcagagcaagattggcgtacagggtgccctggacttggctattatgatgggatgcttggacagaaacgagcagccgcacatgcaaaacgtccgcggtatcagcactccgaagaacaagatggcactgtctggtaaagagtcgctcctgcaattcgaggtaggattcgagccgggtcgttgccgctttgacgaaggccagattaaccggtgacttccctagcgccttctatgggggcgctatgtaggtacactaggaggctactatgcttaaaccgtcagacattaactacctcgatgaagaggtaatcaaggcgtacgctgcatctgcaggtactttccgtaaacgattcgcgctggacagcagccagctgattgtgcatctagctatcaataaagctcggagggctgggtggaaatgagtgagtgtattgagcacgggcagaagggctctaagtttgggtacggtagcactacagttacagaagacggtgtgaggcgtagaacatcactgcaccgtgccatgtactgcaaacacaagggttgtaagctggcggatattgacggattggtggttatgcatacttgtgataatcctcgctgcatcaaccctgcccatctaaagttgggcacagggatagataacatcctagataggcaggttaaagagcgtaactataccaagctgaccagggagcaggttatattcattagggagaactacaaaccctatgacaaagagtttggcagcgctgccttagcaagaagttttggggttgacgcatcaacagtaaacagagccgctaatggtcgtggttggagggattatgtctagtagtattatgactatcgatattgaggtcgaaaatcatccgtactatggcagcaaggccagcccttactgcccggataactacgtagtgcactcggcctaccgaatcgacaggacccaggacgatggtaccgttactgtagagcccacctttgacatccgattcaacagcaagcaggcgtttttggacgacgtagccggtgagcatctgtggttccgtataccagatgattgttggctcattgtagcacataatgccgcatttgagattagctggttcctgacataccagcgtcagcacttcgaggagttcttgaagcgcggcgggcgtgtatttgacaccatgcatggtcactacattgctagcgactttcaggatatgtacccctcgttagatgagaccgcacccaagtatgggggtgagcacaagattgatggggtaaaaatcttgtgggagcagggggtattaacatcacagatagaccctattctgcttagggattacctggttaacggggatatcccgaacacggccctgtgcttctacggccagtgcgctacgttcgcccagcgcgggcagatgcagtacgtgtgggaacgaatggatgccttgctggcttgggcgtactgcgagtggttcggcctgttcgttaatatgccgattgcacgcaagaaccaggaggagcaggagcagcgcatccgtgagattaagcaggagctgcagcagtacatcccgaaggacttgccggagactcttgacttcaacttcgggtcggacttccatatgtcagcactggtgtacggcgggcctatcaagtaccgcaagaaggtgccatatgacccgccgcagtacgtcaaggccgacttctataagtacgaggacgaagagggtgcgcacacctatatacctgtacacgacacgcacatgcaagaacttcaaacggaaggcggatggtggcgtgtagtgacatatcgtgcgggtaagaacaaggggctccccaaagtattccgcctcgataccgaggaagagaaacttaaatgggaagacgacctttacttctgcccgggcctggtgaacatccaggagcttccggaagttatccgggagaagtacgcagagcgcggagagttccgacaggcgcgcaccctgcaggacggtgcgccagtatacagcaccagcactgacgcaatggaggcgctggctcgccaagggttcgagttctgtaagttggtgaacgagctggcggcgctggagaaggataccggcacttactatttgcgagaggtccttgacgcagaaggtaaggtcaaagagcggaaggggatgctgcagtacgtaatcccggagcgtcccgatggttccggcatcattcaccaccggctgaatacttgcgccaccgtaaccgggcgcttgagtagctctaacccgaacctgcagaacctaccccgcccggatgaggatggcgacggtgtggctaaatccaaggtgaagcaggtgttcaccagtagattcggggacaacgggcgtatcactgaggttgactactcggcactggaagtagttatgtcctgcgtccacactggtgacaagaaactgctgggactgctgcagagtggtacggatatgcactgttaccgcctagctttccgtgaggaactgccgtatgaagaagtatatgagcgctgccacaacaagaagcacgagctgcatccgctttggaaggcaatgcgcacaggtattaagactcctagctttgcagcccagtatggcgctacggctaagggggttgcgtttgctactggatgtacggtggaattcgcacaggctttcttggacaacgaggctgcgctgttcccgcaaacaattggcttccgcgctattgtcaaggaagaggtagagcgtaccggtgcggagggtcgcatgtaccgggagcaggctgacgacggcagctaccgaatctaccgcattgggacgtggaccagcccagccggtgcccgttacagtttccgccagaaagagcagtggaaggaagttgtgcccggacagcgtaagcagaaggtaatggactacaaggaaactgagatggcgaactactggtgccagggggaagcgttcttcctgatggcggtggcggctggtatggttctgcgtgcactattggcccgtaactggttcgacaatcaggtgtgcctgattacgaacgtacacgatgcattgtatctggacagtgccaacccggaggttggacgtgaggcgagcctactggttaaacagtgcatggaggacgcgcctaagcgtatccaccagctctggcctaactacggcatcattggtgaggtcccgttcccagcagaggctgagatgggtacgagtatgtacagtaaggagaaggttgaatgaatataaagtctggtagtattgtggaattgatggacctggggcctgagccgatagacccacggtatgccgcatacttcaccccaggtacaagacacacggtgctattcttcgaccctgttactggggagatagaactaagctaccctgggctggtagtgagtaggcccggggacggcgtaaccttattcccgggggagtacaagcttatcgaagagtagtgataggtgtacccttgggtggtgtagggggttagggtagcatggaaatatactagggtcaactaaataattaaataaaattatttgttgactctggcttgattctgtgattccccgagaattaatgtgatacgagtaggaacaacacaagagagacatgcagtgtcagaatgtatagaccacggcaaaagccgaagccttctaaaagaagggtatgcgttagttaaacgtgacggaaagatgcgcctatatcatcgagtggtttacgtccgccaccatggtataacctatgcggatatagacggacaggtgattagacactcatgtgacaatccccgttgtattaatcccgagcatcttctggtgggcagcagggcagacaacgtgcaagataaggtagatagaggccgcgaagctcgtaagatttccaagtctactgtagagcagattcgccgggagtatgttcctcgttctaaacacgccaatcagtacgtgcttgctgcgaaatacggtgtagtacaatctcgcgccagtcaaattattaagggggcctaataatggcacgtgttagcctaatcaaactattcacaaaagagcagcaccaggcgattttaaagcgcttccaaagtaacgccgaagctgcctgggcgtacgagtatgtactagcatttggtaagattcctggcgaagatattagtgctcggacaatacgtacggttgtggggatggggattccggccccgcaagtgtcccgccagcttgtgcgctactggcgaagcatcttcgtggataacaacggtagtaaagccagcgccaaccgtgggttgcaggaagcgcgcaagctaatccaaccaagcccaacggacgatatcgggaatacaaaggtgccggatatgtgtcaccgcatcctggtggtaggagacttgcacgccccgtatactcacgtagacgcaatacccttccttgagagcgtacgtgatgcgtactgcccggacatggtggtgcaggtcggtgacgagaccgatgggcacgctatcagcttccacgactctgacccgaacctagacagcgccggggtagagctggagaaagccaagctagtactggaggagctacatgaactattcccgaacctactggtttgcgattccaatcacggcagtctggtttaccgcagggcgaaagctcacgggctaccagtgcaatttatcaagaagtaccgagatatacttttccctgaacatggtgccccggcgtggtcttgggctgacgcatgggtactcaataccccacttggcccggttagattccagcatcaagtgtcgggcgatttcatgctcaatgccagccacgaaagaaccagccttgtacttggccacgaacatggccgctttgaggtgcaatatgcagctagctcaacagctttgtactttggtgcgtacgcggggtgtttgattgaccgtaagagcatggcctttgcttacggcagactcacccgcaagaaaccaatcctgggtgtgatggtaatcaccgagggttgcccgcagttaattcctatgctgctcgacgacgatggtcgttgggttggtcgtactaaataacacagaggtgatgatgaaaatgggaatctgttctgtactgggtcttatctttgtaactctgaaactgaccggagttatcgcctggtcctggtggtgggtactgctcccgttctggggacctattgtagttggcgtagttctggtgttcttggtggcggccatcaaaaccgcctcacgataagccctgcatctgcacgtaaatatcatttaaactaaacgaggacgtaattatatgactacgaatgtactggcatccctgaacgctctggtagacgcagcaatcgaaacccaagatgtagatatgcgggaaaccgcacagggtgggtcgtacgaggacgtgctgctgccgaagggtgagtactacggctacttcaccgagtacgtggaaatcggtaagcgtctcccgactaagggtggtaagcctacgggtaagcctgcggtggctaacgtacgcatcggcattgtagtgttcggccctaacggagaagtgaagcgtatccgcccatacccgatggctatcagtaactttgagcgggcaggcttcaagaagttcttcgataagctgaactacgataacagcattaagcatgcagcacagcgtctggggcaggccttcaccttcccgattgatgagcacaccagtgccgcgggcaagaagtctaacatcgtggacctgtccggtatccgcccgattccgaagttcgacccgaacaccggcgagcctatcaagatgccatccctggatgcctccgagattaagctgttcctgtggaacaacccaaccaaagagacctgggatagcctgcacatcgaaggcaccttcgacgacggtaagagcaagaactggattcaggaggatatgtacaaggctgtagacttcccgggcagtgcactggatattctgctgaatgctggctcggttccgagtccggcagccatgcaggcaccagcagcaccggctgctcctgcgaccccgactgctccggcagcacccgtagccccggcggcgccggtggctcctgaggcccccgtagcgccagcagcgcctgctgcacctcaagtctaatatacggaggcatacgtgaacagacaaagaagccttgaatacatgctgtctttagctaagcgccttaacgagattgtcgatgaaatgaaagctagaagcaacgcgctgctttctgcgaagtctactaatcccgaagtaccctctgcacctaaatctaagcaaccgtaacctaaactaatacggccccgcctggggccttagaggaagcctatgaatatcatcaaagcactggtacgtctcttgaagtatgcctacgagcaagaagcccgcaaagcggacgctgcttctgctaaatgcacggcaggttcctgctcagcagctgatcgtgctgttgaattggccgccgctgctgatgccgctgcacaagaatcattggatttggctaacgctgcacttgaccactccgctagggctgacgcactgcgtgcgaagcgctctgaggtggctaactttctggaggttaaataatggaccaagtactgaacgcgtacaagaatctggctattgtagtgagtaatgcagtccatgatgccgcggtgtatggtgtacgtatcaactgcctggacagcgtttatgccgccctagaaaagctggcggccctgtacggtatggacctggacctggccgctaccgccttccgggagcacaacgacctggcggcacacgccgacaagctgagcggcgatgacatggtgcttatccgtgtagtgggcacgctcagcatcggcctggctgagattggttcctgcatttacgacgtagaccagagcctgcgtactccggaagtgattggggacatgctcggcaccgtgctggtgctgtctgagttggaggcttgagtatgttgtacgtatctcgcgcaatttatgtagctttgattctcccgctgattcctttggcgggactgtgctatctcggcgataagctgagcaaggcaaagtgggcagagcgttgggttaactgggccgacaagaaggcccgcgatgttacggggcgctaatgaatactccatgtatacccacaacctaccgcctaaacaactcgggttacgggagttgtcgctacatgggcaaaagggtaggtgcccatgtagcagcatacttaattgctaacaacttaaccccagatgatgtagtgggtaaggttgtgatgcacaagtgtgacaacagggcctgcgttaatccggaacacctggagctgggtactcagtctgataacatattagacgggtaccagaaaggcagaatagggcaaggcgagcagctgcgtaagcgcaacctaaaactctccaacgctgatgtggcgtctataaagagtcgcttagttaagggctgcgggggaaactgtaaggaactagctgcagagtttggcgtccattggatgtacatcctgcaggttgcaaaggggtatcacgatggtcgtaaacgggattgacttgagtaccttagcacctcaggatgtaaagcccaatgaaggtaaggtgctattactcgactcagatttttatgtctataaatctgcagctacagtgaaacgtttggacactgcaatccgccgcttctatcagctactgcttgaggacatgttcctggtaggctgctcagaagcagtggcgtatctgacgcctacggggtgtgctaagtgcctgcgctggcacctgcctacggctaagccgtaccaatggaaccgcaataagcgtcaggagctgccactcaaggcacctttgaagcggcacctgattgagaacccggaccagtattctgagcatggcatacaggtggtaagcagtgactactttgaggccgacgacctctttgtaatggattcgtacagcttcggagaccggggaatcctgatgtcccaggacaaggattcctggctaagcccaatggcccggttcgatatcccgaccggaaccgtgtggcctgccttggataacccattcggctggattaagtgggatgatacccaggctatgccggtgcgagcacacggcaccaagttcttctggtggcagatgctagcaggagatgacgcagataacgtcaaaggcatcacgttgcttgatgggaagctctgtgggaagcgaacggcctttgatgctatctaccctattacctcggagcaggacgccgcagaattcgttgtagcggcctatgctcgaaacaaccaagacgtactcgcagaggcagaatgcctgtggctgagacgctcccaatcagattcagcgtatctgtatctgatgtcactgttgactactcccagtctacgtgactgggtgcattcgctgcacgagtaccataaacagcatatacagtggatacaggagcacccagacaatggcgaagatgtctgcgaaggaaatgagcctgcgcgcgattgagttatactacgaggggaaacacggtgaacttgaaactattctggatgcgctgcgtgaacgagcacccaaaacacatcgaagaacggttgagcatttggattctctcattcacgacaatgctctgctggatttagttggggagattgaggtatggccctaagaaagattacacgggcacagattcgctccgtggctattaagcttgccaaagaccagggaggtatctgcctcctttgtggcaaacctttggacttcacaatcaagggggtaactggtgattctgttgtcgttgaccacgatcatattactgggcgtattcggggtgctcttcatcgctcgtgcaatggaggggaaggcaaagtggcatctgccgctgggcgctggattgttggtagcatgcaatcttctagggctattgctgaatctctacgtagggtcgccgattacttagaccgcgaacctacggatatgctatactatacgcacaagacgccggaagaattggcacaggcgcagaagctcaaggcccgcaaggcccgggcacgacgcaaagcacgggagactattaagtgaataagttcaaagttggtgacaaagtagtacgtaagcccgagcatcgtaacgaaaactggcgcaagcggtttaaagaccacccagcaggtgccccgcgcactgtgactgctgttcgttttaatgagattattgaattggaccacgtaccttatggttgggatgcagacctctttgacttggtaagtgcaccagtcacgccaaaagagctgcctacacctaaagcacctgacgcagtaaactcaccaaagcactaccagttcttcccggacctggaggcaatcgaggtgattgcgcgcagcatgacgcaagagcagttctacggttactgcttggggaaccggcttaaatatcgcctgcgagccggaaacaaggataagctggagcaggacattgccaagtccgacaagtacttagaactgtacgagcaacaccgaggtaagtgcattgacgccaagtgagtgatgccacatgatgtggcagaaagcagtataacggggcgacgaacgctccgctaaaaactgcctggagatgtacaatctctgggtaagtcgcaatcagtagtcagaagtaccggacataaccaaggagactaagcgcctatgattagcgccctgaatacggttgtagtaccagaggaagcactggtgaaacgccagctggagcttgaagaggcctataagattcgcggaatcgagcgggcacgtaagctgattacggacgcgttgcagaacggtggtattatgaacctgcctatgacgcaacgtatgctcacttcggcatataagtggctgctgccactatcgatgagatgcgaaatgtcaaagcccctggcattggtgggaagtaccgccggttcctgcgcttaatcccattggatgtcctgaccaccctgagcctgtgcacaatgtttgaggcgttcagcgtcgccccaggcgagtccgccagtcgccgtcagactgcacaggcggtaatgtccgcactgggcagaaacgtacagtcagagctactggctctgcagttacgcaacgtagccccagcgtacatggaccgcgtgtatgagtacctcacagagcgccgtacgaagtcccctacgcacatcctgcgtacgctccgtgccagtgccgagaacgtacactatgggcacgagccttggaccaatgcccagaacatctccgtagggcgtctgctgtgtgccgcagtgtttgagacgggactgttccagtggaagaactgtagcgggaatctgagcatgctctatccggctgacgacgttatggaggccttccagaaactggtagagtccgctgataccgtaaccatgaagccacctatgctggtaccgccggtgcagcacactactctgtgggacggtgggtacctcacccctatcgacaatcgcggaacctaccataactcgcacattgacagagctcgtctccgtgaagtagcggaagcatttaagtccgcggacggcatcaaaaaagcgcttaataaggcacaggaaaccccgtaccgtattaataagcgcatactggaactggtgcaagaagcacgggccctgggtgttgggataggtatgcctcgctcagtaccggagccgaaaccggagtggtatctggacggggttccgaaagagaattacaccgaggaagagcttgaccgcttcggtgagtggaagacgcgtatgtctctatggtacagcgccgaccgtaagcgtgtatctcaactgcgcagccttctgactacgttggaaatggcagaggaattcaaagatgagaaagccctgtacttcccgacttgtgttgactggcgctaccgcctgtacttcaagtcctcgctacatccgcagggttctgatttgcagaaggctctactggaattcggtagaggtaaacctcttggagagagagggttgttctggcttaaagcgcacgtcgccacttgctttggttatgacaaaaccctattcgaagaccgcgcagattgggttgataaaaatatggcagttgtccgctcagttgcagagaatccatttgattcggacgcttttaagcaggccgattcaccgtggtgtttcttggcggcagtgctcgatctggtggatgctctggattctccgtgcccagaagagtacatctccagaactccggttgctatggacgctacgaactcaggtggacagcacctctcagcgctcctgagagaccctgtaggcggccgtctgacgaacctgtactgggaaggcaacgacaagaaagcggacctgtacatggatgtgaagcgccgtacggacgagaaggtgatactggacctggacaaggaggatttcgttatccagagcacgtactggagagagaacgaaatcacccgcagcatgaccaagcgccccagtatgacctacttctacagcgccacggtgcgcagctgcagcgactacatctttgaaggcgcttgcgctgaggggtatgaaggtaccgacactaacagtctatggaacctgtcgtgctacctggctccgcgtatgcgcacagctatcgaagaggcaaaccctgctgctgcggcagttatggggtacttgcagaacctcgctagacgtgtaccggcaagccagcacctgcagtggtatacgccgctgggtgggctagtaatgaaccgctacacacagcgtgaagaagtgcgggtacgaattgactgcatgaacctaactatcatgcgcgtgcataaccgggacttcaagacctgcaacaagcgcaaggcagcctccgggattgccccgaactttgtgcatagcctggatagtacacacttgatgatggttctatgtgccgctgatggtctggatattgtgccgattcacgactccctggctacacatgcagctgatgttgatgctatgcaccgacacatccgcgaacagtttgtgcgcctatacgaagagcatgacctgctgggagatattactcgcgcggcagcagcagctggggcagacctgacggacctggatatgcctgaggttggtactctggacatccggcaggtactggaatcacctttcttcttctgctgagggtatggtatgcgagtactagtaactggtgggcgagattacacagactacttagcactaaagaccgcaatggatatgctaccaaacaaaccatctgtagtgatacatggaaatgccagaggggcggacgcactggcagacaggtgggccctggaatctggtatttttgttctgcgtatgccagccctgtggggtgcgcagggtaaatctgcaggtatgcgcaggaacgccgccatgatatccttggcctttccagaatactgcgtcgcctttcctggtggaaggggtaccgctggtatggttgagctatgcagaaaggccggtataccagtttgggtaccctactaaaatttaatgttaccggagtaggaatgaagttaaaacacactagtaaaacttccgactacactctcaaggttctgtataagtcagacgacattacaggcgcagtgaagcaactgcacgaactgggccacggcattagtcggggcctggctccagagcagcactactggagggtactgggaagtatactgggtaaacagtatatactaggagtctatgactcccaaggcgacttagtcggtgctgtcagctattatccagaagctgtagaggactgtcattacgtagagcctgtgctgtatacagacttcttcgtattaaaaccagacaacggcgcggcagtgtctgtgattatgcagggcctgcatgcaatagccaagtgcatgcgcgctgggcgtatagccattagccggagcacatcggataacacgtacaagacaacttatcatttagtgaggtcagaatgagtggtggtttaggtaaactgttaggcaaggccacggatatgctgggccttactgataacgcaggattagaggcgcagcagcgcttggcagagcagcaggctagcgcagcgaaacaacaggctgccttagaggctaatagcgccgcagataacattgctgagattgatcctgcaggggctgcctctgcatctgcagatgcaattacgtctgagcagaagaaacggcgacaagcagggcagagcaatcctctgggcctgtaagggggtagcttggaacaaaaagcaacattagcagaactctttaagaaggaccaggacgcgggcgtcttggatgcctctgagaagttcgcgcagtggacgctcagcactatctttaccagggacgattccctggacggtagacgcaggccgctggagcgtgactaccagagtaccggtgcgcagctggtcaacactgcggccactaagattgtaggcgcactgttcccgcaaggtactagcttcttccggttctccaagagttcggacctggacgagttcattagttctctgggcagtgcagctacggcagaatctaagctggccgaggtcgagaacacggcgtcacagaaagtatttgagaaagacggttatgctgcgaagttgcaagctgtgaagctgctgctggttacaggtaacgcgttggagtatattgatgagcggacaggtaaatccatcgtctactcagtccgtaactttaccgttcgaagggatggcagcgggaacgtcctgcgactcattatcagagagcgcgcaagcgttcaggacctgccagaagatttccgtggcaccttctaccgtgacaaagacccatacggcgacgttgatatctacactgccgcttgtcgcaaagttaagcggacagaggacggtgcagaggtagtaagctacgaggtgtatcaagaagcagacgggcaccgtatcggggacagcagcacctacccggagctggagcttccttataacgtgctggtgtggaaccttgttagtggtgagcactacgggcgcggattggtagaggattacgccggggacttcgcccgattatctgtactgtcggaagcgttaaccaactatgaggttgagtctgcgcggttaatcccgctgattgacgcaagctctgggttagacgtggacgagttctcaacgtcggagacgggtgaggctgtgcaggtgggcggtggtggttccaacgggaacagcaaatcccccgtcactgcttacgagggtggctctgcccagaagattcagtggattgccagcaacattcagatgctcgaacagaaactgtcgcgtgcgtttatgtacaccggtaactcccggcagggtgagcgtgtcacagcttacgagattcgccagaatgccaaagaggcggaagctgctatgggtggtgggttcagtattctgagcgacacctggctgcgtaagctggcgtacctgtatactgcactggtgtatcctcgctttaagctttatctcagtgaaggtgtagtgaacatcaacgttactgtgggtacttctgcattagctaaagccgcggcagcggacaagctgttagaggcggcgcaatccatgcagctggctatcccggtgcttgagcagattactcctcgcttcaacaaagatgcgtgcgtagattggtacttcgacgcctacggtatcgttagcgagccgttcatgtacaccgaagagcagctgcagcagaagcaacaggttcaggatgcgtctgccgatgtatccgcaggtgcagcacaggaccaactccagggcttgacagcagcagacccgacagtagcaggtaagcagctgggcttattaccaagttaacaacagaggcatagatggataacgtagaaaacggtcaaaacgtagaaactacacaggtagagaaccaaggcggccctaagattccgggcctaggtgctccccttagcgccccgaacaatcaaggcgtgcaggatgtgcagacccctacccagcagcaacagggcaaagattcccctgaacctgctaagattcctctggatatcgaagccttaaaagcggccctggataagggtggcgatagcgctaaggagcagcctcaggagctggctaagacgggcaacccgacgattgatgccggtgtagctatgttgcagaaagtctctgggttaactgactctgatatggtgcgggcacttggtaaggccctggattatcaggaccctaacctaatcgatacggccttcattaaggaacgtttcggagagcacgctgcttatgcagagttgctggctaaagcgtacctggaagaccaggttggtcaagccaccaaggcagtacaggaagcttacgatatcgtgggcggtaaggagaactgggaggtagcagcgcagctgtttaattccaaggcccctgaacctctgcgtaacgcagctcgtgtactcgctaactcgggtgagctcaagcaggccgctgagctggtagcaagcttctgccgggatatgggtcttatcaagacacagaatccaatggtacgcggtgtagccagcaacaatgcactatctgctgcggaattccgcgcagaatataccaaactccgtcaggaagcgggcaaccgtagcttggcgtctccgcagttcagtcaacgttataacgatttgctcgcacgccgtgaagctggtaagcgcgtaggtctttaatctcatttaaaaggaaaagtaagatatggcagataccatctataaagctggcttgaccagacctcactgggcaggcgcgcagtctgatgtagacgttcacctggaagtataccagaacgaagtggatacccgcttccagtaccaagctctgttcctgggcctctccagccagcgctctatcagcggttccaacacctaccgtattgaccgcctgaacacctcctcggtgaagggtcgtcgctctggtgagtcgctggatagcaccccggtccgtaacgataagatgattatcgtggtggatacggtgctgtatatccgtaacccgattgactaccaggatgactggaccggcccggacttcctgaccgagatgggtcagaacaacggctctgagttcgcagaggtcttcgaccaggcgcacctgattcagctcatcaagggccgttcctgggttgccccggcgcacctgaaaccggcgttcaatgacggtatcgaggtgggcgcagctatccttgttccaggtagcgcctccgccacgcagctgactcaggctgagatggaggctaacgccatgaacatcaacctggcgcacaaggctggtattgatgagctcatcaagcgcaagaccccgctggcggatatggtcactctggtggatgtcgatacctattcgcgtctgctggagcatccgaagctcctgaacatcgaattcggcccgtccaacaacgacggttacaaagaccgtcgtgtagtgaagatgaacggcgtgccggtagtagagtgcaccgagttcccgacctcggctggtacgcacccgctgggctctgcttacaccgtcaccgctgacgacgcgctgtgccgtatggtgactttcagcaagtccaagaccctggtgactgtcgaagctaagccgttcacctcccgtatctgggacgatgagcgtgagttcagcaacgttctggactgctacgcgatgtacaacatcggcctgcgtcgtccggacaccgctgcagtgactaagttcaccttcaccaccaagccctaattggaggttcaatggcagtaatcgctatgttcggtctggagactctccaggccaatgcagctcagcgggaggcggttaaggccgccaccgatgtagcgaagaacatccaggtggcgtcggttgaatctggccgcaaggctaccaagaaaacccgcaaggcggctgatgtagccgcggatactgcggaagagtaatacgcgcccctggtgccttcgggtgccaggggctttttttttgtccctgtcttaaaggtccagggggtctttaatagaggaacaaatatgagagaattagacgctgtgaacctgacgctggaagcccttggggagtctcgcgttatggacatcaacactagtaaccctagcgctggattagctcgctctgcactcgcacgtaaccgtcgtgggttactcagcacaggattctggtttaacgtggtagagcgtgaagttacacccaccaccgacggcctgattaaggtgccgtggaaccagctggctgtatatgacgcctgctcagaatccaagtacggtgtacgtgacgggaacctatacgacctggtagagcagaatcaatacttcgatgcgcctgtgcgtattcgtgtggtactggatttggcctttgaggacctgtcggagcatgcagctatgtggattgcaaactacaccactgcgcaagtgtacctgaacgacctaggtagtgacggcaactacgctaattacgcacaggaagctgagcggtacaagagcatggtgctgcgcgagcatctgcgcaatcagaagttcagcaccagcaagacccgttttgcacgcagaatccgccgcgctcgttttatggtttaaggagaggttatgggtaagtttgagatggtaagcgccgcgctggatgctcgtgcagcatatctaagagcgtgcttggaggtgtatcatagctagttcattagaaggtactattcagagcttgctgcagggagtttcccagcaggttccgagagagcgccagcccgggcaactgggggcgcagctgaatatgctcagcgacccggtttccggtatccgccgcagacctcctggagaaattgtctgggagagtacaattgataatccggggcttgattccctgttcaccgagtatgttgagcgtgggactgacggtaggcacctgctgattaataccagcaacggtaactggtggttgctgtctaagaacggcaaggccgtcattaattctggcaatgacccatactttattgcaacagcaggacagacctccttgcagaccacaagcattgcgggtctgacttatatcttaaacacggaggtgtctccggttactgccgtggacaactccggacgtattgaccccagcaccactggattcttctacgtcaaggccgcggctttccagaagcgctgggaggttacggtgacttggtccgggggatctgtcacagggtactataacgtaccagacgccagcagtggtgcagcgtctgcagagtgggcgtctgcgtcattcgtgataaatgcacttattaacggagaccctaacgggtccggtataggggcagccatcacagcggctgggggtacagtagtcggctttggggcgtacatgtacatagccgggctacctaatttagtagtgagtacgtcttctggtgatacgtatgcagtggcgtcagggcagagcagggttccccaggaacaggacctgcctgcacagctccccgcagaagccgatggggcaatgtgccgagtgggtacggcctcgtctgagactgcatggtatcagttcaattacagcgaacgtacctggtatgaggttggggcatacggcagtatcaccaaaattacgaacatgcccagagagcttgctgcggatgacaacattattgcgcgggattgggagggacgtttagctggtaacgacgacaacaacagcgacccgggattcgttgagaacggatacatcactggtattgcagctttccagggccgcctggtcctgcttagcggtagctccgtggatatgtcagcctctggcctgtatcagcgcttctatcgttctaccgtgacatctctgctggatacggaccgtatcagcattagctctgcgtctgcacaggattctgtgtaccgcactgctgtgcagttcaaccgggacctggtcctgttcgccaacagcatgcaggcggttgtacctggctcagcagtgcttacgccaactaacgcaagcattagcattaccagcacctatgattgtgacagccgtgtgcctccggtaatggctgggcagacagtaatatacccgaacaagcgcaacgacagctacgctggtattctggagttaatcccatcgccttacaccgcggcgcagtacactacgcaggatgccacggtgcacctacctcggtatatcccaggcagggtattgcagatgcaaaactccagtgtcaccaatatggccttctcgcgcatgtctggagagcgtaatagtctgctggtctacgagttcatgtggggcggaagtgacggcgcgaagatgcaggcggcgtggcataagtggtcgttcccgtatccaatcctgagtgtacaggcgctggaggatgaggtgttcttgtacatgcaagggcccagtcccagcaacaagcttttgattgtgtctatggacccgcgtgaaggttatcagctgggctcagaataccgcgaagcctactcggatttgcagaagcaagttcaagtgcaggacggagtgttcactgttccggcggtattgcgcccggttgggtgggcggacaactacaaggaagagcttatcctaacgtacttacccagcaaccctatggggcctactgaggttggcatcaaggagattgccggggagaacaccctacgggttgtgcgcggcgtacctgatggcacttatgtaatcgggagacgttaccgtagtacgttcacgctaactacgcctattctacgggaccagaatgacaagctcgtgggaagtgggcatgtgcgcctgctgcgtctggacgtggcagtacgtaactctgggcacttcgacgtacaggtactagacaccccgcgggacgttaattggggtggagaactaaccggtatcctgatgaactcaaaggagctgacgcttgggcaggccctgcgtatggacctggctacgattaccgtgccatgtcgtaccaacgcagacacaaccgaggtgtcactatttactgacggttctatggaactgaacgtgctggatatctcgtacatcctgcgctacaaccaacgcagacggagaatttaatatgtggtggatggttgcggccatggccgctaagaccgttctggggcagggtgctcagattgaagtgtccaaggccaggaacaaggctgtgattcaacagacagccaaacagctaaacgacatcgcgctacagcgcgcccagtccagggaccggactgaggtgtctctgtttaacattcagcagcagaagctgcaggcacagagccaagtagggctgcaggcagcagcttccggcactatgggagcctctgttaaagacgccgtagccacggttaacactgtagccgggaggcaagaggccagcgtgcgtgaccagcaggcaactcaggaagagggcttccgtctaatgacagataaggccgtggatagcggcctggctaacatggatatggaggacccgtacgataacatgtttaactcgctgttgagtgtcggggcatccgctgttgggcagtacgccggtaacgctgcgtcatcttcagactctggcagctcttcgcctgggagcggagcgtcagctacgcagagcatggcatcctcctatgacttatgggggagtaagggcaatagcccagttcacacctggtaaattaggaggaatactaaatgcctgtaattcaacccggtagacaggggttaaatatcggaggagtgcaactgcagtccaacgatgttagcttaccgtcaacggtaagtgaagtatctgttgatacctccaaagcaaaacgcctagccgccctgtctggattcgtgcaggacttcggcgtaggtttcgacgaggcagtaaaagaaaacgccgcagccgccaccgtgcgcggcgctatggatgctcagggcgcagtagatgcaatggcctccaaggacgaggctgtacagaagcaaaacatcttcgtgcgcgaagcctaccaggacggctacgtatccgccgccgcgtacgacactctagccaagtggcgcacagacagcatcgccagggctaagaaagctgccgaggcagggctgactgacgaggaattccagcagcaggagcaagagcacgtacagtcaatgtcagacaagctcgggatgtatctcccggatatgtccaagcagtctgctacgagtatactgcagcagctccgcgctaccagtatggctaactatacagccttccagaaaggacgtgctgcgttcgccctggcccaggctgaccgtgcccttgaccgtggactgagtgcgtccagcgatgagttctatcagcgtctgcaggcaggacagggtgccgccgcgcagatgtccattaagacgggcttagacagtatcctggctgcggggcacttggacaagaacaagaagctggaccgggctaagcagtatctggttagtgtagcgcagcagacgcaggacccgctggtaattaaccagctgcaggaaatggccaccaaggaactcggcgtcaactccgtggatgtcaacgcagcactgtatcaggagttcaagcgcgccggtgctcagattgagacacaggcccgtttcgaaatctctgatgcaatccagtctcttgaggggcagacccctgagcagcaagaacagacaatggcgcgtattcgtagtcgtgtcattgagctgtcggcatctgatgtacttagcgccgggaccagcatggagttctggaacaaggctcagaccattcgagataaggcagcagacgcccaagcattgcgcacagcaattactgggaatatgccaagctctactctggcggggatgttcaagggcgacttagataaggcacgtactcagctgctcaagagctttccagacactccggaagggaacctgcagctgctggcgtacggaagcaacagcaaggatgcgtgggccgtcaacgaggcgcacaagcgtatgtcttcggacatggctcgtacgcttactacattggaccagctaggcgaggatggtgaggtttcccgtgagaacgtaaacagcatcaacttgtgggcacaggcttatagcaccagtacggacttaggtaagatggcactgctgtctgaggtcccgtccgagtggcagggggtggtgcagaaagctattgcacaaaacccgagtaatgccagcaatactatcttggatgacctgcgccgccaggcgcgtaacaaggccagtggtcgctacagcaacatccagagtaaccctacggacaagatggtggaccctagcggcaccagtaactggttcagcttctttggtacagcggatgcgcagcgtcaggaagcgcgtgctgctatggaagaggagtaccgatacacctacagccacaacccagagtcgttggttggtaaggaccctgacgacatcaacacgatgctcaagggtaacatccaagcccgtaagctggagctggatatctctggagcacctcggcatgtgtacctgccagctgggacttctatccaatccctaatgggggattaccgaggggaccaggagcagttcaaggtatccctgcagcagcagattcagaaccaggtcaacgccttaatcgacccaagcaaccttgagcgcgtagtggtgcaggctgctacagcaggtaactccgctcagaacatgaccatcaccaccttcgacaagaagggcaccttccagactatgtctgtgaatctccgtgatgtccaggtagctgcacaggacgcttacgataaggcactgtctggtgagatgaagattggcagtgagcaggtcggtatccgcccagctacgttctacgaccacgacaacggcagggctgtgagcgtacaggtcaacgggcgtaatggggccggtgtagagccttcactattcagtgagattctcgccaacaccatgcagttcgagggattccgggaaggcaaaggtaagggaagcgtaggcttcggcctgcacatcaactccggtatgccggttccgaagaaggttactatcgacgacggtatcagcattctgaaatcctccctggagcagcagtacattccgaacgtgaacaagcagctgcgcgggcagggcttgagtgcttctgcggacgccatgaaggttatggtggacctgaactatcacggaggtaacgggagttccggcccggtggctgaggctatggccgcagtgcgcaaatcgaaagacagcgcaggggctgcgctatacagcatccctcaggcatctgctgccgctcttactattctaagacagcagcccgcctataaggaagcgcaacctaagcgtaaacagtatctcgagcaacatctacaggcttggatatttgaagtaacgcactaacagaggcccttcggggcctccccttatcaaaattcttttaggagataatatggctcagtttctgaaccaagaaccgaatccgcaggaaaaggattctgctaagggcgcaacacttaaacctgcgcctgcaagcgtagattggaatgacgctgatgatggaggtgtatctgccctagagcgcgcatccttaatggctcaagccaagacccccgcgacgtcagcaggggatagctttgctgctggggtaggtaatagcattgtggctgcggctatccgcaaggcctctgccccggcatttatgccagagcagggttttgatgcgaagaagtactcgggcacggattcccgcacaaagctgtatacaccaagtgcagaggaaattgagtatctgcacggagccgcttcccgggaagagtatgattaccgcgtacaggatatgcttacgcaacgtaaccgtgaccggatgatgtcagacaacgtcgctgtaggagtagctggtatgttactaggggactcccccttcatattagcccccatggcggctgggggcattgctggtcgtaccggcctagcagtgcgctctgctatccgtgctggtgatgtcgccacggcagtgtatgcacaggaccagttggggcagtctgctggggtaacggcactaatagcaggggtttccggtatagaccaactgtgggatatgtctagggcagcaaaggcggcagcaaagctgcgcacagggcgagagcctgcgtttgacccggatgcgcctacaactcgtacagcaagggacactaatgttaccggagtaggagagaggaccctagactctattatggatgaagtgttggctgaacccatcaccgtacaagctaagaatgtggcgggagttagcttaaaggcacatcacgttacacagtatctccgcagcacgggtacgttgactcgggggcaagaggtacttttggacgcaattgagccagtcgtgcgcgacgttgatttcacgctaatggcgggcactgaccgcgttgtcgctaggagtaggtacacatttaatccggacaaccttacagctcctggtactgtggcgctacgcgcaccggcggcagcggaggggagcacttggaatacggttggtgacgcgctgcgagctgcagacgcagagactcgaggagcagctctgcatgagctaattcacgcagctacctccagagcgctggatgcggacccgagtcttgtagagcgtttaaagccgattcaagagcaccttcaacaaacggcaaaccttaaaggggagctaaagtacctcgcctccgacccgcacgagatgctcgcgggtttagctaacaactcagattgggtgcagcttctgagcagaacgccaagtcaaacagctggtaaatccgtacttcgccagctaggtgaggcggtgctgcaggcctttgggattactgctagaggttcttctttagatgacgtattaaatacatttgaagctgctgttaagtggtccgcagacaacacccgcgctgcgcagtacgagttccgctcagacattatgcgcgaagcggcagagagcgcactaagagaacagaacgagttcttaaaggctaaagctatgatggaaggtactaaaaaggctttcgctagaaacttcgccctgtatgataacatcgctcagggaagtgaggacctggcccgactcctggtatctgacgctacttcggttggcgcgcgccgtccatctgtggtggattataagcgcaacctaacccttgagatggatgccagcgctgtcattgtggaagacgctatactgagtgcgttaaaggctcgtaacattggaccgctatctaggttcttccaccgctcaaatttccgcgcggcccgtgcggatttagagtcccgcctgggacactacttggactccgcatatgatgcacagttaaacggaagggcagtacctgtaccagaggcggatatagcccccctggtggaagcatataaacgctctgggtgggccggtaggtggcacgaccatatgagcgcagcagggcttctggatgatgcggatgtcttaaaatcggactactacttcccgcgccaatatagctacgacaagttgcgccaagggttattggaaggcagaactctggacaactaccgggatttattccggcaagccctgcgggatgtctaccccaacattgaacctgaggttgtgcagcaggtcgctaaagaaatggtggatggtatatacaacggtagggccgctggtcgtgggcctatgtggaggcagttgattaatggcatgagcgaagatgagctgcttggggctatgcgtaatgcaggagtctctgatagtgccattaacagctttgctgcagctaacctcagaagctcaggggccacaaacccggctaggaacttacgtcaccgtaaccgctttaatatgagcaaggagtacatggttgacgggcaggctatgcgtatgcaggacctgatggatacgaatgtacctaaggttatgcacggctacactaatcgcatgtctggtagggtgggtatggcctacgcaggagtgtccgaccttaaaactctggaaaccatgattaacgccagcaagcactctgtggctaaccccgaaaagtgggagcgtgtagtggatgacactatagacttcatactcggagggatgccggcagatgcaaacttaccggatatgcttcgtgctgcgggtaatattgcaaatgccaccatgctaaagaactccggactatatcagcttaccgatacagctttgtcattgaagactttcggtatgacacgggtagctagaagtatggcggagcaaccctggtttaaagaaggtgctgtggtgtttggctccaaagatatgtccgagcgattggactctattctgcgcggcggcgtacaaagggatatgcgttttcgttggttcaacacctacgcagacgacaaccttgacttaactagacaagccccttggttcaacgtcacgcaaaacgtaggacaggcggcgcgtcacgttaacggcatgagcatggtgcacaggttgcaagtgaacctaaactccggcattgtagcggacgaactcaagcagatgttcaagggcgactccgaggcattcaaacgccttgagaagttcggcttggacagagatgtggcggatagggctattgcagcagagaaggctaacccaggcgcagtatttgacccggagctgcagatgcagattgaggttgtaggggtgcgtatgatggactatctggtacagcaaatccgtaccggtgaaacttcacacttcgctcaattcaacccggtgggtaagcttatcgtaggctttcaaagctttgctgtagccgcaaccaacaagattttgcgtcgagagttgaacgatgctgggtggattgggttggcgcacatcatggcatatcaattcccattaatgttgttagccactaaggctaagcacagcatggatggaaaggatacggatactcgcagactagttacggaagctgtaatgggaatgagcgccattggtggtatctcgcttctgcaggataccttcactggggattcaccgcgtcactcgttggcgtctatgggttatgtcacaggactgcttggggctgtgcaggacctggctaccggtaatatggatatcaagaccttcactaagcaggtaccgttaatccaggaattcgcacctacgcgagctatcatcaataacttcggagacgattaatatggcatacagctggcaagaacaaatcaagccagctggtacccaggatatccagtgcgatattgagtatttggacaagtcctatattcatgtatacctagacggggtggaaaccactgggtacacctggaccagctctactaatatcagacttaacacagccctaacagtgggcactacggtactgctcattcgcaagactgagcgagagtatctgtacattgagtttgctagcggctccccgttcatcgaggtgaacgtagactcccagaacacgcagttcttgcacttggcgcaagagctggtggagggtcgggctatccccggattctacggcactattagtatgaacgggtaccgcataaccgacttagccaacccaatcaactcccaggatgctgctactaaggcatacgtcgacgccgctgacgccttgctggggcagcgtattgacgcagaggccgctacgcggaaggccgctgacgatgccttgagtatgcgcacgtccgctctggagaacacctttataagcggagtggagacagtaagttacccttggagtacagtgttagccgaggctacagacgaagtaactcccggcttggccttcactaaggctgtcgtggaaattaacggggttgggcagattcgtggttacagtttcgagattatagacaacaccatactgtttgcagagaccctccccgccggaacggttgtggctgcccgactgggggccgatgtaaccgcaggagacggcttcgctacacaagcgtctgtggactatttggcggactctctgggagatttggcatatcttgatacagccgaagctgtgcctgatgcaacaggtgccggagatgtagtggctcaactaaatgctctactggcatcccttcgtaccagcggggtactggcttcataataggaggaagtatggctggggcagctaaacgtagtcgcctctcggagctgcaccgcatgttcaccgaggccttgattgaagaaatcaagcagtctaaggaagacgaggtgccgctccccgccgcagataaatcagttatcgctaagttcttgaaggacaatgacatcaccgcggatgcagattccgaggagatgcaggaccttcgtgacgagttcgatgacgaactagcggcgcgtagagaggcgcgtaagaaagagattttaaacaagattagtggctcagactctgaggacttactagaaggaattgtctaatggtatcggtgaagactgcgcgaagactgcgcatgctcaaccagaaacttactggttatagtgcgaatccgcgcagtattcccaaagaggagcgcgaggacatcgcaatgatgatggccgcagcgctaagcgacttccgggaattcgcatacatcggtatgcggttcctgggctttactctcacggacatgcaggccgatattgcagagtacatgcagaagggccctaggaagcgtatggtggccgcacagcgtggtgaagctaagtctacactagctgcactgtacgccgtctggaggctcatccaggaccaatcatgccgtatcctgattgtgtccggtgcagagaagcaggcgtctgacgtagcgaacttaatcattcgtatgctggaaacctggccgctgctgtgctacttgaaggctgaccctacacgtggggaccgaacctcctttgaaggttacgacgtacactgtgacctgaaacctctggataagtccgccagcgtcgcctgtgtaggtatcactgcatccctacaggggaagcgtgcggatctgctgattcccgacgatatcgagaccaccaagaacggcttaacgcaaacccagcgtgagcagctgctgatggtttctaaagacttcgcagctatctgtactcacggggatacactgtacctgggcacaccgcagaccaaggacagcatctataaaaccctgccgggacgtggcttcgaggtccgcgtatggcccgggcgcattccgtctgttgaaatggaagagcgatatggaagtacacttgctccttatatcctggagcttattgagcgcggctataaacgcaccggcttcggtgttgatgggacgctaggtgagagcacggaccccgggcgctatgacgaggatgcgctgattgaaaaggaactggactttggtccggagggcttccagctgcagtacatgctcgacaccaccctgtccgaccagatgcgtacgcgtatcaagctttctgatatgctggtttactctggtagccaggattcctctccggagacattctcctacattgcggaccgccggtacctgtaccagcatgagcatgaggggattatgggtcagcagatgtactttccggcattctacggggacatgcacctgccgtaccagcataaggtgctggtggtggacccggctggttgtggcggagacgaagtgtcctacgctgctgggggtgctgcgaactcgtacattcacctattctccgtaggcggcttccaagggggtatcagcgaagagaacattgataaactgattgacctgtgcgtagagttggacatcccggatatggtggtggagagcaacatggggcacggtaccgtgtctatgcttatcctgaaccggctgcgggagcgccgtctcgccggtgttggtgtacgggacttgaataactccacgcagaaagagcgtcgtatcatcgacacaatcagcccagttactcggcgtcatcgcctggtggtgcatgagcgtgccattcacgacgatatcagtacctgtatggcgtactcccgcgatagacgttggctgtactctgcgttcgcacagttgtccggcatcacgtacgaccgcggtagtcttgctaaggatgaccgagcagacgcaatcgccatgatggtggctacactgaacgggcatctggtggaagatgagaaagtggtggctgagcgtgagtctgagaagctggctcgggccttcattgagaacccactggattgggcacagagtaaagtgtctaagggccttcggggtgtagctgctcggctgcagaaccgtggcagaggtaaacaacatagaggaagaagataatggcatcaataatcgcggctaaaactgcggacgtacagtacgccattgtaggcacgtgccagaacctggagaagcaggtgcagccggactacaacgtgggcttcgtaggtacgactgcactgactaagctgaacacgttcttcacgtacatgcagtcccagggctatacagccacccgagccggtacagccttcaaggatgatggtacgctgcaggcacgcctgttcagcatgctatcgcagccctctaagactggctacgtcgcccttacgggtacaggcatgccgctcggtgggggttccggcacagcatttgatgattcgttcactgcactgcaaagtgcgttcgtagccgctactgacgcggcagaataaggagagtatacatggcaattgcaaaagcaaccccagcacagcagcaggagctgctgcgccagctgaacattctcggtaaggacctgtatgctatccttacgcagccgcagaacgtggcccagaccggtgctgccttcgatactaagattgctgcgcttgaagctgcagtagccgcagtgaggctgccagataatgcgtaagctggtcgctgggttactgctcgcggttactctgactggttgctcggcgacctctgcactcaccggcttagttggttctaagccggatgtatctgcccaggttggtgccgagaacaccaaacaaaccgttggcttgaataacaaggtggactccagcaccaccaacaaaactgatgtgtcagattctaacgtaggcactctggatacttctagcaagaagcaagtgcagactattagtaccggcacaatccaggcagagcgcctgcaggtggttaacaatgatagttacagtcttatcctcgccggattagctggggccagcattcctctggtcttcctagtggtcattctggtgattcgtaagctattcaggaagaaggggcagcaggatgattaaggtaggagacatggttgggtcggacctcgctacccgggcaggtgcagcagttaccggtgccacggtatcaggaggttggttggcagagttaatgagctggaactggagcactattagcttcatcactgcgacggtgtgcgcggtgctaaccctggcgtggaatgcgtattacaagcgacgtacattcaagctcctagaggagcaggcacgtaaggggactattaaatatgagtttaaggactaaggttattgcggccctcacgggggccactatgctcggtggtgctatcactggagtgattcagcacaacgagggcttgagccttaccgcctacaaagacagcgcgggtatcccgactatctgctacggggagacaaagggcgtcaaaatgggccagagagccacactgagcgattgtcagaagcaactgatacaatcagcaggggagcatgcaaaagctcttgacgggcttcctatgcagctctctgacgtggccctgctaggtgccctggacttcacgtacaacgtaggcgtggctggtttcaacggaagctccgtgaagcgccacctcaaaagccttgattatgcatcggccgcgaaggctgtactggactggcgttatattagcaagtaccagaagaattccccaggggttgggtgggcgcacaagggcggtactcgctggacctttgattgctctcagtacatcaacggacagcgcaacaaagtgtgctggggtctgtgggagcgtaggcaatggcagagcaaggccattgggaaccagtataggaatgtaaactcagccctggctgaattgaaacgataggtgatgatatatggcactagtagatttagtgagggctgggggatattctgttgagtacccgcaattctccagtatggctaagctaaaagcattcccgcactctgaggacgggcaacttgttaggttgttgtcttggcatgagggggttggtttaggtggtgggctgttcaaggtcagcaccagcagcaccgctacaggtaacgatggtacggtagtagtggctagtaatggagtgcggctgcttcgagtagtaaacggacctatctgggcagatatgtttggtgcactaccaaattcagatatagacagtatgccagcagtggctgcggcttatgcgtacgctgcttctgtgaatacggacctgtatatcggggtggcgacttacaaattcaagggaagcactccaattaatgtagacccatccagggccggtattattggctatcaaggtaaagtgcgcattgactgttctgagtttactggttcgattgtgttttctataaatagcagctatagctatacccccgcagcctactacaacaaccttagcccagccctgcaggggctgtacgtgtttggtgctaaaacgtccggagtagacgggctactggttggcagggaaacagtgggatcggacaagagctataacgggcagaccgaggttcgtgagtgcacgttcgataagtttgaccgcaacatccgaatggggcacaactcttggcgctttgtgttctacaaagtaaacagcctaaacgctctcagccctaacgggatattgtatgtaccggccggactagatgactctggggagattctgtcgttctaccactgccagttcttcgatggtgcaggtagtaatatccgattatcttgctcctcatacactatggtatttaatacctgctcgttcctgaacatcacgttctttgtggattcggcgagtagtgcgacagtaacctgtaacggatgcaacttcgagaaccctggaagtgctagtacccgtagatacgttgacattagtgctgggcacactaacgtattcaacattatcgggggcagtatagttacaaacagcaaccctggacagactcaggcgcttctgtatgtctctaccgacaacctactgaaccttgtaggtgtaactgctccttacggcgggcactaccagcaggagcaggagctcgggtatcacgcattcatcggaggggccggtacagtcacaacctctggggttatgctgcagctacgcaacggggcgggtacgtgtcctttgcactccagtcttagcacgttcagtaactggaattttggttatgggaacctgaatgcttggacggtagataaggggactggtacatcctctgtggtagagtatctggctaatgctggacctaaaggtacagagggagctatgcgagttgctcctgtaagtgtcggtaccaacgtatcacaagtacaggcagtaactaaccccggcatgttcagtatgtcctgcatggtgaacattgcgacgacccccggtaacgcggggcaggtatctattgggttcttggatgctgccggtaacagtctacctggtggggtatcagctaacctgggtaccaccacaggttggcaggtaatcggcaagaacaccttgcggggcaaagttccaatcggcgcaaagcaggttcgtgtgaacattcagactgtggctggcgcagacgttaagtacgcgtacttgctgtgcaatgtggtcaagtaacggcacttgttagcactggtgcgcccccggggaaatccagggggcttgcacgtctatacctgaacccaaaatttgttagactcacgcgagcccctccctcaccctcaacgcgcccaattgcccccatagggggtgcctagcgtcaatttagggggggggggcactgggtggggcatgctagggccagctagtgcgcaccagcgggcctcagtggctctctgcgctgcgctagggctatcgccagtgctaccctatggctatccctgtgcgttcactagggcgcctcctgtgcgctctctgtgggccataggggt

SEQ ID NO: 99 - DNA, 40163 bp, Bacteriophage A44-K5-1
tctcacagtttacacttttggttatccccccggtaccctccagttcacccaaagtaaccatgggccaccccttaacctttggttaaaccttaggtgggaccgatgggaatccttaggtgatactatatgttgtggtgtgggacaccttgggatactatatgttgatgtctctgtgtcccctatctgttggccctttaagtcacaccttaggttagacctgaggtcaccaccttaggacatcctgaggttagacctgagaccatattaccttaggtgagctgactgctcacgaggttcaccgtttgactaacgtttagcagtgactgttagtaggtcacattaggagagtcggtaagtatctcgtttagcagtccctgagacactaagagcgggacaagatgatatcggcgagtcatcactataaggcgattggtggtcagtgtcaacaccataatcaattaggtcacactatagggagacacttaaagtattactatgagaccattaccaataagaccactatcactataggtctacttaaagttcaacttagggtattgacattaggtaacagctatggtctaatggctaccagttgagagacacaacgctaccaactaccggaatacttcgagttaccggatagatgctgaagggtctcaagtagccatcaaccggcatacgaaagtggttgactcaacgatgaacaagtagtaacgtagtaagcaagcagtaactagcagcaccgctctttaacaatatggattagtcgctgatatgtacaccatgacattagtgtttaactagtggttgcattcaggtctctggcaaggtacgtcctgtcaccctgagagtagccacgatgataaccactaactgaaggatatacacatcatgatctacaccaaagagccagctaacatcttctacatgtacgtatcaactgcacgtgccgaccgccctgatgtggtgaatcttgcacgtcacaaccaactcaagcgtgatatcttgaacggtcttgggatgtacggtgagattgtacagacaggcatcactaggtatttccgcgaggctgggcaagctgtagccactgaggagcgcaccatcaaggtggcttgcaggacacgtgaagagtgcatttgcttgacacagcttgtttgtcgagcgtatcagcaagactgtgcattggtcatcaagtcacaaacgcacagcgccgcccttatgtcatgccctgagggcttagcgtacaaggcgcagcgtctcaacgggtcactgcagcaagtggatgcacctaagggtgaatgctacagcgtagacgctaacggtgttatctgggaggtggtgtaatggtcaagtacggcctcactaaggaggacctgaagtattaccgattcgctctcatgcacggtaaacaccacgactacctaatggcccaactggcccagacctatcgctcacgtaaggtgatgtatgacaaccctgttcgtaattagtgtgtacgccctgattgtcctgtactttgtgctggactttcgtaagggtctcaaggtacacaaagcatctttcagttacctgaagtggggcttcttgcctcgctttactgtacggctacctaatggccgatttaaggcaaacaaagtgggggtattttatgtcgcaacgcattgacaaccgagtctaccgcgacaagcatgggttcgttatagtgtacatcgtaaaagatgattgttacgtctatgcagacacctgcgaatcaatgctatactacccaagcgctaacacccgcgagacgtgggagcgcattggcaccaacctgaagtttaccgactgacactcacatcgcacacacaaggaaacaacctaatgaactacaccgatatgcaagcacgcttagacgtcatccgtaacctgccaatctgtgaactcgacaagcgccagcctctgctggttgcactcatcgcagacattgtgaactgcgagacgtccgacggtgacgatacggatagcgattggggtctcgaacgtcaggactattggcaaaccctgaagattaaggccaaagacgctgggtttaacctgctgggcaatggtcacttcagcgcagcgtttaagcacgagctgatgccgggtagggtcattaaggttggctttaagaaggaggactcaggagccgcctacgtggctttctgccggatgcaccaaggtcgggtagggatacctaacgtctatcacgtagcgcgtcacgctggatgctacacggtggtacttgatgagctggaaccatgcaagcgcagcagtaaccacttgcacgatcgctacgcagacctagcgtattacttcgtcgagtgtgactatgagcctgaggagcaccaccagaaggacttaccattcatcgagacgtgccagatgattcgggacttcttctgtgggattgcgtccttcgatatgcacagcggaaacatcatgttcaccaaagacggcaagccagtgattaccgacccggtgtcattctcagcggaccgggaccgtgagcctttctcactggaacctgaggagctacttgcagagattgagcagatagcgcacgacaagatgattgaacgctgtaagcgcaacaaggctaagcgagaccgtgacagcacgttgtgtcgcgcccgtagggccaacaacaaggcccgcagaaaccgcgccaaagcgtttgctagacgttggaaggagcgcgaaaagcgtgacgctgagattttaaaagagggcctagcgaaaatcgaggagcgggtactggcgtggtacatgggaccgggcctagccatacagcagggcaagccgttgccaatcgacaactaccttcagggtagacttatgggttagcaaggtgtatcttaggtgtctctcacgcaagaggcaccaatagataaactttattcacaaagaggcacacaatgaacgcattaaacattgcacgtaatgacttctcagagattgaactagccgctattccgtacaacatcctcagtgagcactacggggacaagctggcacgtgagcagttagcactggagcatgaagcgtacgagctgggcgagcagcgtttcctgaagatgctggaacgtcaggtgaaagctggtgagttcgctgacaacgtggccgctaagccgctggtcttaacgttgcacccacagctgaccaagcgcattgacgactggaaggaggagcaagcaagcgcacgcggtaagaagcctcgcgcatactacccgattaagcatggtgtaccctcagagttggcccttagtatgggcgctgaggtgctcaaggagaagcgcggagtgtccagtgaggcaatcgcactgctcaccattaaggtcgtcttagggacgctaacagacgcctcaaaggccaccatccagcaggtatcctctcagttaggtaaggcgcttgaggatgaggcccgattcggtcgtatccgtgagcaggaagccgcctacttcaagaagaacgtagcggaccagctggacaagcgtgtaggccacgtgtacaagaaggctttcatgcaggtcgtcgaggccgatatgatttccaaagggatgctgggcggtgacaactggtcgagctggaagaccgacgagcagatgcacgtgggtactaagctgcttgagctactcatcgagggcactggtctggtggagatgaccaagaacaaaatggccgatggctcggacgatgttaccagtatgcagatggtccagctggctccggccttcgtggaactcctgagcaaacgagcgggcgcactcgcaggtatcagcccgatgcaccagccgtgtgtagtccctccgaaaccttgggttgaaaccgtaggcggtggctactggtcagtcggtcgtcgcccgctggcgctggttcgtacccactccaagaaggcgctgcgccgctatgaagatgttcacatgcctgaggtgtacaaggcggtaaacctcgcgcaaaacacgccgtggaaggtgaacaagaaggtgctggcggtagtcaacgagattatcaactggaagcactgcccggttgcagacgtcccagcgattgaacgcgaagagttaccaccgcgcccggacgatatcgacaccaatgaggtggcacgtaaggcatggcgcaaggaggccgcagcggtctaccgtaaggacaaggcccgccagtctcgccgcttgtcgatggagttcatggtcgcacaggccaacaagttcgctaaccacaaggccatctggttcccgtacaacatggactggcgcggacgtgtgtacgctgtgagcatgttcaacccacagggtaacgacatgaccaagggtatgctgacgctgaccaagggtaaaccaattggtctcgatgggttctactggctgaagattcacggcgcaaactgtgcaggtgtcgacaaggttcccttccctgagcgcatcaagttcatcgaagagaacgagggcaacattctggcgagcgcagcggacccgctgaataacacttggtggacccagcaagattcgccattctgtttcctagcgttctgcttcgagtatgcaggcgttaagcaccatggcctgaattacaactgctctctgccgctggcgttcgacgggtcttgctctgggattcagcacttcagcgcaatgctccgcgattccatcggtggtcgtgccgtgaacctgctgccctccgataccgtgcaggatatctacaagattgtggccgacaaggttaacgaggtgctccaccagcacgctgtcaacgggtctcagacggtggtcgagcagattgccgataaggagactggcgaattccgcgagaaggtgacactgggtgaatccgtactggctgctcagtggttgcagtatggcgtgacccgtaaggtcactaagcgttcggtcatgacgttggcatatggttccaaagagttcggcttccgccagcaagttcttgaggataccatccagcctgctattgacaacggcgagggcctgatgtttacgcaccctaaccaagcggctggctacatggccaagctgatttgggacgctgtgaccgtgaccgtagtggccgctgtggaagcaatgaactggctgaagtctgccgctaaactgctggccgctgaagtcaaggacaagaggaccaaagaggttctacgtaagcgctgcgcaatccactgggtaacaccagacggcttcccggtgtggcaagagtaccgtaagcagaaccaagcccgcctgaagctggtcttcctcggtcaggccaacgtcaagatgacgtacaacactgggaaggactccgagattgatgctcacaagcaggaatccggcatcgctcccaactttgtccactcacaggacggtagccacctgcgcatgaccgtagtgcacgccaacgaggtctatgggattgactccttcgcgctcattcacgactccttcgggaccattccggcagacgctgggaatctcttcaaggcagtccgtgagacgatggtcaagacctacgaggacaacgatgtgattgctgacttctacgaccagttcgctgaccagctgcacgagtctcagctcgacaagatgcccgctgtccctgccaaaggtgacctgaatctgcgcgatatcttggagtctgacttcgcgttcgcataaggtctcaggcaattagggcacactatcaggaacatactaaaggtcatcatccggtggccttcatgaatgtcccttactagcacaatcaggagtaacaccatgtatcagaatacaatcaacttcgagcgcaaccgtgaacgtcagcagactgagggttatatccctaagggccgcaagctgaacaagacaaagcgcggtggtggcgtgaagggttccttccgtaacgcgaagggtgacagcgttgttaaccaagagaaatacttcgtaggagcataacaaatggctgagcaaactaaatggctgttcgacgggagcacatcacagtggtctcgcttaggtcacaccgagcgtagactgctggacgagacgggactccgtgtaatcatgacgtaccgcccattcaattgcacagtgttattctctgtgtatgaacctagaccggattacgacgaggtcctcgtggagaagtccttcagtcgctggtcgattgactcagcgtcagactggctggcaaaactcaccgccgactactcaagctggaagtaattaggacacactataggcagactcaaggtcatcggattccggtggcctttatgattgcttattgcacactaaatgaacactacacttcggagacatcatcatgctgaacattaagactaatccatttaaggccgtatcattcgttcgctctgctatcgagaaggcgctggagacttccggttacctcatcgcagacactaagcacgatggtgtgcgcgggaacatctgcgtagacaacacggccaacgcagcgtggctcagccgggtctccaagaccattccggccattgagcacctcaacggtttcgaccagcgctggcagaagttactgaaagatgaccgctggattttccctgatggctttatgcttgatggtgaactcatggtcaaaggcgtggactttaacaccgggtctggcctactgcgcaccaagtggctcaagaaggataacatgcagtttgatatcggcggtccatacgaacaatgggagccagacatgaaaggccaacccttcgcactccacccgaatcacctcaaagttgtcctctacgatatcattccgcttgatattatcgagtcaggtgatgactacaacgtgatgaccctcctccgccttgagcacgtcaaggtagcattaccagtcctgcaagaccacttccctgaagtcgagtggtgcctctcggagtcccatgaagtttacgacatggatgaactcgatgcgctgtaccgacagaaacgagaagaaggtcatgaaggtctggtggttaaggaccctcgcggtatctacaagcgcggtaagaagtccggctggtggaagctgaagccagagaacgaggctgacggtgtcgtagtgggactcaactggggaactcccggtcttgccaacgagggcaaggtgattggcttcgaggttctccttgagtctggtcgcgtggtctccgctaacaacatctctcaggcacttatggaggagttcacctctgcggccctaactcagcaacttaacggagacactcaggcgtatattggctgggcgtgccaaattaagtacatggaggaaaccccagacggttctctacgtcacccgtcgttcgataaatggcgtggtaccgaggctgacccgaccatcaagatgtaattaggacccactataggagacaccaaatgtctatcaacctgattctaatcatcgttttcatcctcgcggctatcgtgtggtcaatgaacgacgagccacctaaaggagcataaaccatgcgcttacacttcaataaatccaacggtatcttctcggttcgccgggaggaccgcagcactgtagcagcctctgagcgccacggtaagattccacgtatcggcgacaccttcgagctggcacccagcgtgcacatcttggttactcgcggtctctacgaattggctcagactaagagccgtcctttcgtacccgtagtggtaaccaagtggccgcgccttcgtctgttctgggagcgcatcaaggaggtagtcaatgactgagcgtgaaattcaagtggttaacctgctggttgaacagaatgttgacctagaggattccgcagtgtgcggtgagattggttgctacaaggtttcctgcaagtattgccctttaaataccgaagtttcaacccttggggaggtccgcgcaatgaaggacagcaagactccgagtgtagaagacgatggtgttaagcagccgagtcattaccagctgttcgaaggcgtcgaggccatcgaggtgattgctcgcagcatgacccaagagatgttcaaagggtactgcctcgggaacatcctcaagtaccgcctgcgggctgggaagaagtccgagctggcaaccttggagaaagacatggcgaaggccactttctatctggagctgtacaccaagcacaagggtctgtgttatgacgccaagtgactggtgccgagcgatgtacgagaagacgctcgaccctgcgtacatcaccttgtataacatgtggaaggagcgagaagatgcaaaagttcgtcgtaacggtcgagacagctaacgcttcgtatgaactcccggttcacgctgggtctcttgaggaggccctcgaagttgccgaggcggagtacgaagagttaggccaagtgactcgggtccgacctgatactaatttcgggttcgacctgtagtcattaggacacactatagggacacaggttgtccctctttctgttataaaccaaaggaggacgctatgtcccttattaaaatcatccgttcagctatcgtcaacaacaccgttagaaattttcagtatgaagaaatcatgaaggagactggctgtactcgccacgtagcgaagacattactgttttccttcttgtactacgctactgaggattacttgcaggacctgctgaaaaactctaaagactaaaggagattcatcatggcattcgctaagaagaagatttacaccaccaagattggtacctgtgagccgtacgcttacttcaacaagccagactatggcggtgagggttttgagaacccacgcggtacctacaagggttccgtaacgttcaagaacgaagactgtcaggagctggtagacctcatcgttaagacccacgaggaaaactacgctgctcgtctggaagcgcacgaagcgaacccgccgaaggttcagaagggtaagaaacccctgaagccgtatgaaggcgacatgccgttcttcgacaacggtgatggcaccaccacgttcaacttcaagtgctacggttcgtacgaggacaagaagacgggcgagaccaagaagattgttctgggtgtagttgacgccaagggcaagcgcattcaggacgtaccgattattggtggcggttccaaggttaagattcgcttctcgctggtaccgtacggctggtcggcagtagctggcgcttccgttaagttgcagctggaaggcgtgatgctggtcgaactggctacctttggtggtggcgaagacgactgggctgacgaagccgtagaaggtggttacgaagccgacgaaacccgcagccgtaaacctcaggaagacccggaagactggtctggtgaggaagaggcggacgagggtgaagccgaagaagacgatgacttctaatggctggctacggagccaaagggattcggaaggtgggtgccttccggtctggccttgaggacaaggtgtccaagcagttagaatcaaagggcgtcacgttcgactacgaattgtggcgcatcccttacgttattcctgcgagtgaccacctttacactccagacttcttgttgcccaacggtatcttcgtggagactaagggtctctgggaagccgaggaccgcaagaagcacctactgattcgtgagcagcacccggagttagacatccggttagtgttctcttcgagtcgcactaagatttacaaagggtcaccaaccagttacgctgagtggtgcgagaagcataacatcttgtttgccgacaaattgattcccgtagactggctgaaggagccgaagcgtgatgtaccgttcggcaagttcaagcagaagaaaggagcaaagtaagtatggccaaggttcaattcactaagcgacaggagacctctcagattttcgttcactgctcggccaccaaggcaaccatggacatcggcgtccgtgagattcgccagtggcacaaagagcagggctggctggacgttgggtatcacttcatcatccgccgtgatggcaccgttgagtcgggccgtgaccaagatgctgtaggttcccacgtcaagggatacaactcgacttctgtcggtgtgtgtctggttggtggcatagacgccaagggtaaccctgaggcaaacttcacgccagcccagatgcagtctctgcgttcactgctggtagaacttaaggtgcaatacgctggggccgttctgatggcacaccacgacgtagcacctaaagcctgcccgagcttcgacttgaagcgctggtgggagaagaacgaactggtcacttctgaccgtgggtaaacattagggcacactacagggagacaattacgtttccctgttgtcgcttgaggagattactttatgagcaagttcaaagaacactttgacccaatcccgttcctagcgtatgcactgctgggattgtgggcgctgtccttcgtgggctcgtttatcatttcatgcatcaacggtacatcgttatgagttacggagacagtcaagaagatggtcaggagagtatcttcctgttccacgctccgtgcgaaaactgtggttcttctgatggtaactcagtgtactctgacgggcatgagtattgcttcgtgtgtcaacaccgagtgagaggctcagaggaacgtaccgaaaagttatcatcgagaagacccaaaggagggaattacgggatgaatacacaaggttcaggcttattggtattcggcgagagtgacggtcggtatactgacctgactgctcgcggtatctcaaaggcgacatgccagaaggctggctactgggtcgccaaggtccgagggactgcctatcaggtggccgactatcgtgaccagaatggctccatcgtctctcagaagttgcgggacaaggagaagaacttctctacccgagggtctcacaaaggggatgcactgttcggtaagcacctatggaatggtggcaagaagattgtcatcaccgagggcgaaatcgacatgttaaccgtgatgcaacttcaggattgtaagtggcctgtggtttctctcggtcacggtgcgtcagccgctaagaaaacttgcagtgcaaactacgagtatttcgatagcttcgaccagattatcctgatgttcgacatggatgaccccggtcgtgcagctgtcgaggaagccgctcaggtcctccctcccggtaaggtccacgtggccgtgttaaccgagaaggacgccaacgagtgcttactcaaaggcaagggcaaggaggttctcgaccagatatggaacgcagcaccttgggtaccagatggcgtcatcggtgcgatgtccatgaaggaccgagtgcgagaggccatgaccagcgaacaaagcgtaggataccttttctcgggatgtccgggactgaatgaccgaaccttgggtgcacgtggtggcgaagtcatcatggtcacttctgggtcaggaatgggtaagtctacgttcgttcgccagcaggccctagggttcgccagagggcaaggacttcgggtaggtatggcgatgcttgaggaatccgtagaggagaccatggaggatgtcctagggattgccaatggtatccgcttacggcagcagcctcgggagttcaagcagaaactcattgaggacggtacgtacgataagtggttcgatgagctgtatggctccgaccagttccatctctatgactcctttgcggaagctgaggtggaccgcctgctggctaagctgcactacatgcgcacagggttgaactgtgacgtaatcattctggaccacatctcaatcgttgtgtcagcctcggaggaatccgatgagcgcaagatgattgaccgactcatgaccaagctgaaagggttcgctaagtcaaccggggtggtacttattgttatttgccacctgaagaaccctgagaaaggtaaagctcatgaagaaggacgtgctgtttccattactgacctgcgtgggtctgggtctctgcgccagctctctgatactatcattgcccttgagcgtaatcagcaaggggacatgcctaatcttgtcctccttcgtattctcaagtgtcgctttaatggtattggcgttggcattgcggggtacatggagtacaacgaaaagaccggactccttgaaccgtctagctacactggcggagaaggagaaggagatactggctgggaaggccacgaagaagacgactactaaacgtaaatgcaacggggcgtactgctggtgcgcctctgaccctgattaccaataactggaaggagaatcaccatgtttaaacttatcgaatcactgggccgtctggtcatcgcactgtacatccgtgaagccaaggcactggacaaagcgtccaaggtggaagcgaaagcagccgctaagctggctaaagcagccgacaaggcacgtcaggcatctctggatgcaaccgcagaggcagctaaagttgccgctaaagctcagaaacttaaggagttcttctaatgactaccaaagttaaattccccggaaacaccatccagctgtccgacactgctgaccagtggggccgcaaggttcacatcaacgttcgcaacgacaaggtcactctggtctaccgctggaaggcgaagagcgacaaccgtgcgcacactcagcgtgtgaccctagacgatgttcaggcagctcgactgctggcatccgtagccgtagcggcgactgtggctgtgggtgaagacaaagttcgggaggcactcctgacaaaagaggtaggcgaaacgtctttatgtctggccgcagcgtcagaagctaagtgataaactcaaggtcattactatatgtagtggcctttatgattaccacacacaacatattgagaggacattaccatgcgtaaacctgaagagattcgtaaagagattgaagcgctgaacaaagagctggctgaggccaagacctatgaagccaagcgtgacgctgccgttcacattctggagaacttagggtggacccacagtgggcacaagggctggcagaaacctgcaccaaagcgtagcggctacaaggccccgctgaaggctggtgagctggcaacgtgggatgacaaggttctgggtggaatagtgtacatccgaagcgttggcgacaagtttgctcaagtgtcccacgttcgtggtgttagtagactgggagctgatgtactgaacaatagctttgctgtcgagaagagcaagttaacagtgcgccctcgtgagtatttcatctgacgtcattgagtaacaggagaccactatgttagtaaccgatatcgaggcgaacaacctcttagagaaagtcactcagttccactgtggggtcatctatgactacagtacggacgagtacgtatcgtatcgaccttgggacttctcagcgtatctcgatgcgttggaagccgaggtggctcgtggtggtctcatcgtattccacaacggtcacaagtatgatgccccagtgttgaccaagctggccaagctacagttaaaccgtgagttccacctgccgcgtgagaacgtagtggacacgttggtacttagccgtttgctttttgcgaacattaaggactccgacatggccctactgcgttccggtaagttacccggtaagcgcttcgggtctcacgctctggaggcgtggggttaccgcttaggcgagatgaagggtgagtacaaggacgacttcaagaagctccttgaggaacagggagaggactatgtggacggtgctgagtggattagcttcaacgagccgatgatggcctataacgttcaggacgttgtggtgactaaggctctccttgagaaactgctgagcgacaagcactacttcccggatggtgatatccactggtgggcacacgatgccgtgtcgttctgggacaactcgtgtgaggccgtctggctggaacaccgagccgcttggttactcgctaagcaggagcgcaacgggttcccgtttaacaccaaggccattgaggagctgtacgttgaactcgctggtcgtcgttctgaactccttcagacactcaccgacactttcggaacttggtaccaacctaagggaggcactgagttattcctgcacccgcgcaccgggaagccgctaggtaaatatccacgagtgaagtacccgaagcagggtgccatctacaagaaacccaagaacaaagctcagcgtgagggtcgtgaaccctgcgagctggacactcgggattacgtggagggcgctccgtacacaccagtagagcacgttgtgttcaaccctagtagccgagaccacattgcgctcaagctgaaggaagccggatgggtaccgacagagttcaccgacaagggtgcacctaaggtagacgacgaggtacttgagcacgtgcgtgtggaagaccctgagaagcagcgctgcatcgacctcatcaaagagtacctgatgatacagaagcgtatcggtcaggcggctgagggtgacaaagcgtggctacgttacgttcaagaggatggtaaaatccatggttcagtcaatcctaatggtgccgttacgggccgagcgactcacagcttcccgaacctcggacaagtaccgggcgtgcgaagtccttatggcgagccttgcagggctgcttttggcgctgagcatcaccttgacggcctcactggcctaccttgggtacaagctggtatcgacgcctccggtctggagttgcgatgtctcgcacacttcatgtccaagtacgacgggggagcttatgcagacgttattcttaacggggacatccacacagtaaaccagcatgccgctgagttgccgactcgtgataacgccaagacattcatctacggtttcctctatggtgctggagacgaaaagattggacagattgtgggcgcaggtaaggaacgtggaaaggaactcaagaagaaattccttgagaacaccccagcaatcgcagcgttgcgtgaaggaatccagcagaccctcgtcgagtcatcccgatgggtcgccggagagcagaaggtcaagtggaaacgacgctggattaagggactggatggcagaaaggtacacgtacggtcaccacatgccgcgctcaacacgttgcttcagtcagcgggtgcactcatttgtaagctgtggattgtcgagactgaagagttgcttctcaaggctggcttgaagcacggctgggatggtgactttgcgtacatggcgtgggtccacgatgaaatccaagtagcgtgtcggaccccagagattgcacagcaggtgattgacactgcgcagcaagctatgcgtaacgtgggagaacacttcaagttccgttgtcgtctggacacagaaggtaagatgggtccgaactgggccgtatgtcactaataatacaggagatttaaccatgggtattaacaaacagtttcgcgtaacgttcgatgtaacggcgactatgagtaacgagcaggagcaggagttcctcaaggacctgctggaacttgccgattctgtaggcacggacaagcgtcaggcgcacatcgtcaccgaggcaatcaccaacggacacgaggcggcgctcgccttcgttctacagagtggtcttcgtgaagcaatcaaggagcttggcaaggaggtcaactgtgagtcagtgaccgtacgcttctccccagcaatcgtgagggtgaccaagtgagcgagtacctcaaagttctggcggccctcaagggctgccctaagtccttccagtcgaactacgtgcggaacaacgctgcgttagtcgctgaggctgcgagccgtggtcacatttcatgtctgaccatgagtggtcgcaacggtggcgcttgggaaattaccagtgccggagtgaaattccttaagacccatggaggttgcttatgagcaaacacacattgttatccttcagcgactaccgggcaacccagaagattgccaagggtgtccttgtgatggatggtgactggctggtgttccaagccatgagtgccgctgagttcgatgcctcgtgggaggaggagatttggcaccgttgctgtgaccacgctaaggcccgtgagattctggagaactccatcgagtcctacaagggccgcaagaaggcatggaagaatgcagacgttgtcctagcgttcactgaccgtgtcaactggcgcaagctactggttgacccgacgtacaaagagaaccgcgcagtcgtcaagaaacctgtgggttacttcgagttccttgagtacgtcttcgagacctacacgtgcgtccttgagcctcagctcgaaggcgatgacgtgatgggaatcatcgggtctaatccgcttccgtatcactacgagaaggccgtactggtctcctgtgacaaggactttaagaccatcccggattgtgacttcctgtggtgtacgactggtaacatcctcgtgcagactcaggagacagccgactactggcacctcttccagactatcaagggcgacatcaccgatggttacggtgggattcccggatggggcgataccgctgaggacttcctgaaggaacccttcattgttgagcctgtaacgtccgtactgaagtccggcaagaacaagggccaagaggtaaccaagtgggtgaaacgcgcccctgagccgggagagacgctctgggactgcattaagtccattggggccaaggcagggatgaccgaagcggaagtaatcaagcagggccagatggctcgcatcctccgttctgatgagtacaacatcgagactggggagattactctatggcaaccgggcagctgattctcatcgtcctgaccatgggcttagtcgctcgtggtctctggatgttagccttgattatcaagcagatagtcgagcacaaagaagagtgataaactcatgggcacaattaggacccactatagggaagtgcccattatgattattacttaaagattacttaaagaggagactcaaatgttaaaacctatagagcacatccttaacaatcctaatgaccttcctgacgtaccgcgagctgtcaaggagtacctacagtctcgcttcaatgctgacttcctgtatcagtcagaggtccgtaagctgcgtgaggctggccacagtgaggagttcatctccggggtactgtatggtcactacatggcttctcgtgtccttgatgagatggagggccgtcagcgtgcactcaaagaaggagattgattatgtgtttctcacctaagatgaaagcacctaaggtcgacacaacgactgtccctgagccagcgccactgacggaggaacctaagggtgtccagtacggtggtgacgaggactcaaataacaccactcctgaggtgtcagggcgtaagtcactcaaggtggccaagacgaccgagcctacagggtccgtcagtaaaatccgtaagtcagctttaggaggctaacatgggactgttcaagaaaatcaagaaggctatctccaaggtagtcaaggcaccactcaaggctgttggcctggcagcagatgcacctaacgtgcaggcagccgctgagacacctgtggccgcaccacaggaagcaccgaaagaggtcgtggaggacgtcgagtcttcagcagacaccgagtctggcaagaagaaaactcgtgcgtccggcaagaagtccctctcagtttcccgcagctcaggcggtgggattaacctgtaaggaggtgacctgtggcagaagttaaactcgaaggcttcgcagaggagggagccaaggcggtttatgaccgtctgaagaacgaccgacagccttacgagacacgagcagagtcctgtgcgcagtacacgattccctcgctgttccctaaggactctgataacgcatcaaccgattacacgactccgtggcaatccgtaggtgctcgcggtctgaacaacctagcgtccaagctgatgctggccctgttcccgatgcagtcatggatgaagttgaccattagtgaatacgaagcgaagaacctactgggtgacgctgagggtctcgctaaggtcgatgagggcctctcaatggtagagcgcatcatcatgaactacatcgagtccaacagttacagggtgactctctttgagtgcctgaagcaactgtgtgtggccgggaacgcgctgctgtacttaccggagcctgagggttataccccgatgaagctctatcgactgaactcgtatgtggtccagcgagatgctttcggtaacgtacttcagattgtcaccctagacaagattgcgttcaacgctctccctgaggatgtccgcagtcaagtggaagcagcccaaggtgagcagaaggaagacgctgagattgacgtctatacccacgtgtacctgaacgaagccggggatggctactcgaagtacgaagaggttgccgaagcggtggttccgggcagtgaggctgagtacccgcccgaagagtgtccgtacattccggtccgcatggtccgcatcgacggtgaatcctacggtcgttcctacgtggaagagtatctgggcgacctcaagtcccttgagaacctccaagagtccatcgtgaagatggccatgattaccgcgaaggtcatcggtctggtagacccggcaggtatcactcaggtccgccgcctcacggcagcacagtctggtgcgttcgtaccgggacgtaagcaggacattgagttcctccagctggagaagtccggcgactttaccgtagcgaagaacgtaagcgacaccattgaggctcgcctctcgtatgcctttatgctcaacagtgcggtacaacgtacaggtgagcgagtcacagctgaagagattcggtatgtggcgtcagagctggaagataccttaggtggtgtctactcgattctctcgcaggaactccagctgcctctggtaagagtgctcttgaagcaactacaagccacgcagcaaatcccggagttacctaaagaggccgtcgagccaactatcagcactggccttgaggctatcggacgtggtcaggaccttgacaagctagagcggtgcattgccgcatggtcagccctcaaggccctagaaggtgatgatgacctcaacttggctaacctcaagttacgtatcgctaacgctatcggactcgacacggctggtatgcttctcactcaggagcagaagaacgcacttatggcgcagcagggtgcccagattgccacacagcaaggggccgcagcgctgggtcaagggatggccgcacaggctactgcaagtcctgaagcgatggccgcagcggctgattcagtcggtatgcagccgggtatgtaattagggcacactatagggagatacatccagattgaatgaggtctggtcagaaggttcgagtccttcgtgtttccctcttagtcttaactttaaggagattgaaatggctggcgaatctaacgcagacgtatacgcatccttcggtgttaacagtgctgtactgactggcagtacacctgaggagcaccaagaaaacatgttggcactcgatgttgctgcccgtgatggcgatgatgcaatcgagctgaacaccaacagtgatgacccgtatggttccgatgtggacccgttcggtgaacctgaagagggccgtatgcaggtccgtatctccgctgacggttcagacgaacaggatggcgaagatgataatggtgaagaagaacagcagggcgaagatgagagtcagccggaggaagtaaccgacgatggtgaacctgaagggttcaaaccgattggtgaaactccggctgacatcaacgaagcctctaagcagctggaagaacacgaagctggctttaacgacatggttgccactgcaatcgaacgcggtctctcacaggatgctgtgacccgtattcagcaggagtaccagaacgaggacagcttgtccgatgaatcctaccgagagctggccgaggctggttacagtaaggcgttcgttgatgcgtacattcgtggtcaggaagctctggtcaaccagtacgtagagaaagtgatggacttcgtgggaggccgtgagcgcttccagcaggtctacagtcatatgcagaccaataaccctgagggtgccgaggcgctcatcaagtcctttgagtctcgtgatgtagccaccatgaagacgattctgaacctagcgggacaatctcgtgataaaacctttggtaagaaagctgagcgctctattgccaagcgtgcaaccccagcgaaacctgctccacgcaaggctgtaggcttcgagtctcaagctgagatgattaaggcgatgtccgacccgcgctaccgcaccgactctaagtatcgtcgtgaagtagagcaaaaggtaatcgactcaacgttctaatgaattaggacacactatagggagactgacaacctcgtaataacggcgaccattcgtcaggtgcgagactgtgctatcagatagactaggagattatgggtgaggcctagactcccttcgagttacacaatgagtatcacctcgtttcaagtagtacctcaacagcttggcaacgataggcccgtttggtcagcgtaatgactaattctattcttaaacaacataaggagattcaacatgggtaacatgcaaggtggacagcagctcggtactaaccaaggtaaaggtcaatccgcagcagacaagctggcgctattcctgaaagtattcggcggtgaagtcctgaccgcattcgctcgtacctctgtgaccaccaaccgtcacatgcagcgtcaaatcagctccggtaagtccgcacagttccctgtgattggccgaaccaaggctgcttacctgcaaccgggcgagtctctggatgacaaacgtaaagacatcaagcacaccgagaagaccattaatattgatggcctgctgactgcggacgtgctgatttacgacatcgaagacgcgatgaaccactatgacgttcgctccgagtacacctctcagattggtgagtctctggcgatggcagctgatggcgcggtactggctgagctggctggtctggttaacctagcggattccgtcaacgagaacatcgctggtctgggcaaaccatccctgctggaagttggcgctaaggctgacctgaccgaccaggtcaaactgggccaagcggttatcgcgcagctgaccattgctcgtgcggctctgaccaagaactacgtcccggctaacgaccgtacgttctacaccaccccggacgtgtactctgcgattctggcagctctgatgcctaacgctgcgaactatgcggctctgattgaccctgagcgtggttctatccgtaacgtgatgggcttcgaagtcgttgaggttccgcacctgaccgctggtggtgctggtgatgaccgcccggacgaaggcgcagaagcaaccaaccagaagcacgccttcccggcaactggtggtaaagtcaacaaagagaacgttgtgggcctgttccagcaccgttccgctgttggtaccgtcaagctgaaagacctcgctctggaacgtgctcgccgcgctgagtatcaggctgaccagattatcgctaagtacgcgatgggtcacggtggtctgcgtccagaatctgctggtgcgctggttttcacggcggcctaagcgtaaatacctttagtgctcgggtggtaaccccacctgagtacgaggtacagactgtggctattgctggtgattcacttaaggtgacacttgatgggctggatggagtaacggactggtcaagccttgaggtaacttatggtacttcagggattgccagccacactcgccgtaccaacacgctgtacttcaaaggaatcgctgtaggcgaaactctagtgactgtcagctttgacggatctgaaatgaagtcctttaagctggtcgtgactaactaataagccaaaccccttggggaccactcacggtctctgaggggttttttcgttaggagcttacattatgaacatgcaagatgcttactttgggtctgccgctgagctggatgctgtcaacgagatgctcgcagccatcggtgaatccccggtgacaaccctcgacgaagatggtagtgcagacgtagcgaacgctcgtcgtatcctcaacaggattaaccgccagattcagtctaaaggttgggccttcaacatcaacgagtcggccacgctgaccccggatgccagcactgggcttatcccgttccgtccagcctacctgtccatccttggtggccagtacgttaaccgtggtggttgggtgtacgataagtccacaggtacagataccttctctgggccaatcacagtgacactgattacccttcaggattacgatgagatgcctgagtgtttccgccagtggattgtcaccaaggccagccgtcagttcaactctcggttctttggcgcagaggacgtagagaactctctggcacaggaagagatggaagcgcgaatggcgtgcaacgagtacgagatggacttcggacaatacaacatgcttgacggtgacgcatacgtacagggcctcatcggacgctaacagtaaacttaaggaggaccaaatggctctcgtatcacaatcaatcaagaacctcaagggaggcattagccagcagcctgaaatcctacggtacccagagcagggttcgcttcaggtcaacggttggtcctccgagactgagggtctccaaaagcgaccacctatggtgttcatcaagtcccttggccctcgtggctacttgggggaagacccatacatccacctcatcaaccgagatgagtacgagcagtattacgccgtgttcacagggaatgacgttcgggtgttcgacctgtctggctatgagtatcaggtcaggggcgaccgctcatatgtgacagtcaataaccctaaggacaacttacggatggtcaccgtggcagactacacgttcatcgtgaaccgcaccagacaggtccgggagaaccagaacatgaccaacggtggaaccttcagagataacgtggacgccctcattaacgttcgcggtggtcagtatggccgtaagctcgaagtgaatattaacggtgtatgggtaagccaccagctccctccgggtgacaacgctaaggatgacccgcctaaggtggacgctcaggccatcgctgaggccatcgctactctgctcagaactgcacaccctacgtggacattcaacgtgggaacagggtacattcactgcatcgctcccgcagataccatcattgacatcttggagacaaaggatggctacgcggaccagctgattaacccagtgccccattacgtccagagcttctctaagttgcctctgaacgctccagatgggtacatggtgaagattgtcggggacacatccaagaccgccgaccagtattacgttaagtacgacaagagtcagaaggtctggaaggaaactgtggggtggaacatctcggtcggccttgagtaccacacgatgccttggacactggttcgtgcagctgacggtaactttgacctcgggtatcacgagtggaaggaccgccgagctggtgacgatgataccaaccctcagccgtcctttgtgaactcgacgataaccgacgtgttcttcttcaggaaccgcttagggttcatctctggggagaacatcgtgatgtcacgtaccagcaaatacttcgagttctacccgccgtcagtagccaactacaccgatgatgacccgctggacgtggccgtgagtcataaccgagtgtcggtccttaagtacgctgtgagcttcgctgaggagcttctgctgtggtccgatgaggcacagttcgttctgtcggccaacggtgtgttatccgctaagactgctcagctggacctgaccactcagttcgatgtgtcagaccgtgcgcgtccttatggtatcggcaggaacatctactatgcgtcccctcgcagctcctttacgtccatcatgcggtactacgcggtacaggatgtaagctctgtgaagaacgcagaggacatgacggcccacgtccctaactacatcccgaacggtgtgtacagcatcaacgggtctggtacggagaacttcgcgtgtgtgctgaccaagggtgctcccagcaaggtgttcatctacaagttcctctacatggacgagaatattcggcagcagtcgtggtcccactgggacttcggtgatggtgtggaggtgatggcagcaaactgtatcaactcaacgatgtacctgctgatgcggaatggatacaacgtgtggatagccgcagtggacttcaagaaggagtcgacagacttcccatttgagccttaccgtttccacgttgacgccaagcgctcttaccatatctcagagacggcgtacgacattgagacgaaccagacggtagtgaacgtcaaggacatctacggtgcgtcgttctctaagggcactgtggcaatctgcgagagcgacggtaaaatcaccgagtatgagcccatgggttcctcttgggattcaaccccagacattcgcattagcggtgacatctccggtaaggacatcgtcattgggttcctgtacgacttccagtatgtgttcagtcggttcctcatcaagcaggagcagaatgacggcacaacgtccactgaggactctggtcgtctacagctgcgtagagcgtgggtgaactatcagaacaccggagcgttcactgtgagcgtcgacaacggtagccgtgagttcaactatctggtcaacgcccaagtgggttctactggtttacggctgggtcagaaggccacaactactggtcagtatcgtttcccggtgacaggtaacgccttgtaccagaaggtgtctctgagttccttcaacgcttccccggtgtcaatcattgggtgtggctgggagggtaactacagcagacgcgccaacggtatttaactgaaggaatccttatggtgtgctcaattagggcacactatagggagaccacactaagaggggacttaaagcatgtacataagaaacactgtaagtaatgacttcgagttattcatcccggcctaccatgacgtacttgaggcacaggccatgggtatagaaccatcgttcccagcggttactgagtgtgtcacgttagaccacgatggttttcctttggctataggtggacattgcggagaccagtgctggttcgtcacgagtgaccaagtgtggagactcgacagggctggcaagctggagttccgtgagagaatcatggagtacagggacatgttattgaatgtttattcatccctgtggaacttcgtgtgggtcggtaacggtccccacaagcggttccttaagtccatcggtgctgtattccacgaggagtacactcagggtgggaagttccaactgttcaccataacgaggaggtaactatgtgctggatggcagctattcctatcgcaatgacggcggtgcaggccatcggtcagtcacgcaatgaagccaagatgattggccttcagaatgaccagatgcgccgacagtctgcccaaatgattaaagagtcaaacattcagaacgctaacgccagccttgagcagaagcagaagctggaagaagccagtgcggacctgaccgctaagaatctcgataaggttcaggccatgggtacaatccgtgcagcaataggagagggaaaccttgagggtgccagcatggaccgtatcagtcgaatcgaagagggcaagctcattcgggaggccaacgcggtaaccgacaactatcgccgagactatgcgtcgctgttcgctcagcagctgggtaactctgagtccactatcgaccaagttaagtccatgcagaaagctgagggcaaaggtaagtccaagctggaacaggtgctggacccgctggcattgatgacctcacaaggcgcatctgcatattcgtcaggtgcgttcgacagtaagggaaccaaggcaccaattaatcaggcccaaggtactaaggtaggaggtaagtaatggccagtaaattagaacaagcattaagccaactgccgcaggccgggtctacccgcatccgtggtggctcagcgtccatgcagtatcgcccagtaaccatccaacaggaagggttccgtcagtccaacctagtgcagtccttggcgaagtttggtactgcggtgggcgaggcagcggatgcctacgacaagcgtcagcgagacaaggctgatgagcggtcagatgagattatccgtaagttgaccccggagcagcgccgagaggctatcaagaacgggaccctactgtatcaggatgacccgtacgccatggaggccctacggttcaagactggccgtaacgctgcgttcctcatcgacgacgaagtggcgcagaaggttcagaacggtgagttccgtacccgtactgagatggaagagtatcgccacaagcggttgaccgaaggtgccaacgagttcgctgaacagttcatgattaaccctgaggactctgagttccagagagggttcaacgcgaacattaccgagcgtaacatctcactgtacggtaagcacgatgcgttcctgagtgagcaggcccagaagggtgccatactggcctcgaaggtggaactgtccggtgtccttaaagacccagcagtcctggctcgcccagagtccggtgagttcttccaacgctacattgacaatgctcttaagaccggaagtattcctagcgacgctcaggcacagcaggtcatcattgggtcccttaacgacgtcattcagcgtccgggtgctaccaacttcctccagagccttgcagaccgtccggtaaccctcaacgggaagacctcgacctataaggagctgatgggagaggagcagtggaacgccctgatggtcaaggctcaatcgactcagttcgacaatgacgctaagttgtcagaaggtttccgccttgggattaccagcgcgttgaaccaagatgacaccagcaagggctgggagatgattcaggggattaaggcagaccttgataggttgcagcccggtgaccagatgacaccagagcgtgagcgactgattcaagctgaggagcagatgcagacccgtttccgtcaggaggcccaagcagcggccaaggagatggacaagcgtcagaagactatcaacaagaatcaggtcatcgaccagcagttcactaagcgtatcaacggtcagtacgtgtccaccagctacaaggacatgccaaccaacgagaacaccggagagttcactcacagtgacatggtgaactacgctaacggtaagctggctgagattgaccagatgcagctcacggagcaacagaaggaccgcatgaagctgagctacctacgggcagactcagagggtggagccttccgtaccgttgtgggccagatggtgaccgacgctgggtctgagtggtctgccgctgtgattaacggtaagttacctgaggacaccacagcgttgaacaaactgcgcaccatgcgtaacaccgacccggacctcttcgctgctctgtatcctgacaaagctgagctattcctaacgcttgacatgatggacaagcagggcattgaccctcagattcttatcgacgctgaccgttctcgccgcagtctcaccaaagagatgcagtacgaggatgacaaagcgtgggcggcgctgaagaacaactcccagtccccagaactgtcccgcattccagccagtcttgatgctatggccagaaagatgtatgacagcgtcaagtaccgcacaggcaacagtgacatggctatggagcaggtcgataagttcctcaaggaatccactgtgaccttcaaaggtgatgacgtggatggtgataccattggtattatcccgaagaacatcctacaggtcagtgatgaccctaagagctgggagcagggccgagacatcctagaagaagcccgtaagggaatcatcgcggctaacccttgggtgaccaacaagcagctgacgatgtaccagcagggtgactctatctacatgatggacaccactggcactgtccgcatccgctacgacaaggagctactgactcgaacctatcaggaacagcagcagcgactggccaaggaagccgaagagaaggcactgaaggaagcaaccaagcgtgcgcctatctccgcagccactcaggcccgtaaggccgctggtgagcgtgtccgtgctaaacgtaaagccactccgaagttcatctatggaggtggtgaccaataaccattaaggagacaacatgagctacgataagtccaaacctagcgattacgatggcatcttccagaaggcagcagactctcatggggtctcctacgacctcctgcgtaagttatcgtttaacgaatcatccttcaaccctaaggcagtctctaagactggccctaagggcatcatgcagttcacccgcaacacggcccgcgctatgggccttaacgtgaccgatggagacgacgatgggcgctacaacccggagttagccattgacgccggcgctaagctgcttgcgagtctcgttaagaagtacaacggggatgagctgaaagctgccctagcgtacaaccaaggggaaggcccagatggtgcaccgcagcttcaggcatacgacaatggagacttcggggctatctcggaggaaggacgcaactacatgcgcaagctgctggacgtggctaagagtcccaactctggtgctctggaagcgttcggaggtatcaccccaaagggtaaagggattcccgcagaggatgccttcaagggcatcgctaagactggtaaggtaggtacagagctgccggagtcccatgggttcgacgttgaaggtgtagcgcaggaagcgcccaacactccatacgctaaggacttctgggagaagaccgggacgactcttgacgagtataacgctcggtccaccttcttcggcttcggggacgctgctgaggctcagattcagaactccaccttaggtgttgctttccgcgctgcacgtgctgacgacgggtacgatgtgttcaaggacacgatgaccccgactcgctggaactcatacgtcccatccaaggaggacttgcagaagctgcgcgactccgggttacctccgagttactacggtgtggtgactggtggtgacggcgagaactgggatgcgctcatcaagctggccaaggataacttcgaggctgaccaacgggccgctgaggctggtactggggcgaagctcgctgctggtatcgttggtgctggcgtagacccgctcagttatgtgcctctggtcggtgtggccgggaagggactcaaggtggtcaataaggccctgcgagtaggcgcacaggctggggcacttagcgttgcctctgagggaatccgtacgtcagtagctggtggtgaagctcactacgctgatgctgcactgggtggtttactgttcggcgctggtatgtctgtccttagtgacgctgtggccactggtatccgtaaggcacgtggagtagactctgtgaatgagttcgctgggccagcactccgtatggaagcacgagagactgccatcaacactggcggtcacgacacctcaacgctacctcctgagaacttctcgttcgagcagaaccatagcggtgttccgtttgccaaccacccgaccgaagagggcgcagtggttctggccaatggttccatcctgagcgacaccaacccacttaacccaaggactcagcgtgacttcgcagagattgacccagagcgtgcagctcccggtatcaagctaggtgggttcactgagattggcctgaagaccttagggtccaaggatgctggtgttcgtgcaatcgctcaggacctcgtgcgctctccaacggggatgcaatcagggtctagtggtaagttcggtgctaccgcttcggatatccacgagcgtctccacgcgactgaccaaaggatgtacaaccagctgtatgacgctgttgatcgtgccatgaaggacccagagttctccgtgggtgagcagaagatgtcacgcagagccatccgtcaggaagtctacaagcgtgctgccttggcgattgagcgtccagagttacaggccgatttgaccaaaggcgaacgtgaggtgatggacctgctgaaagagcacttcgacaccaagcgtgagctgatggaacagccgggtatcttcggtaacgccaacgccgtgagcatcttccccggtagtcgccacaagggcacctacgtacctaacgtgtacgacaggggtgctaaggagctgatgactcagaagctgggtggacctgagggactccaacaggctatcgctcagagctggcttaccagttaccgagtgcggcctgaggtcaaggctcgtgttgatgagtacctgatggaactcaatggctacaagtcggttgaccaagtgacacctgaggtggtccagaagcacgctatggacaaggcttacggtatcagccacactgaggacttcacggcgtccagtgtcattgacgacaatatcacaggtcttgtcggtatcgagaacaactcgttccttgaggcccgcaacatgttcgacagtgaccttccggttaccttaccggatgggtcgaccttcagtgtcaacgacctgagggacttcgacatggcacggattatcccagcgtacgaccgtcgagttaacggtgatatctccatcatgggcggtagcggtaagaccacgaagcagctcaaggacgaaatcatgacgttagacaagcgggccgaacgtaagggacaactgaagggcgaagtggaagcactgaaggataccgttaagattctcactggacgtgctcgccgtaacaacgatacagcctttgagaccgccatgcgtaccctgaacgacctagcgttcttcgctaagaacttctacatgggtccgcagaacctcacagagattgctgggatgttggctaagggtaacgttaaggcgatgctccatggtatcccgacgttgcgcgacctcgccaccagaacctctccggtgtccggcagtgaactgcgggaactccatggggcgctgttcggtaaggaactcgaccagttaatccgtccggggcgtgaggatattgtacagcgaatccgtgaggcgtccgataccagtggggccatggcgtcagtcattggtaccatcaagtttggtactcaggagctgtcggctcgttctccttggaccaagatgttgaacggtacggctaactacattctggacactgcccgtcagggcgtgctcggtgatgtggctggtgcggccctagggggtaagggttccaagtttggcaaagagaacttcctcaaagctgcctctatcagtcctgagcagtggaagggtatcaagcaactctttgtcgaccacgcgactcgtgacgctaacggtcagttcaccatcaaggacaagaaggctttcagtcaggacccgagagcgatggacctgtggcgtcttgccgataaggttgccgacgagaccatgctgagacctcacaaggtatcccagcaggattccaaggcgtacggtgctggtgtcaagatggctatgcagttcaagaacttcaccatcaagtcactcaacgctaagttcatccggtccttctacgagggctacaagaacaaccgagctatcgacatggcgttgacccacgtgttgtctctgggtatcgctgggacttactttgcgatgcaggcccatgtgaaggcttacggactccaagagtcccagcgtaaggactacctgaagaaagcactgaacccgaccatgctgggctacgcagcgttgactcgaagttctcacactggtgccccactgtctatcgtctcgatgatggctggtgccgctgggttccaagacgccaacatgctgcgctccaccatcttacctaaggaggaacagttccagaagaaagacggggcgtccaagggtcgagcagagtcaagcaaccttgctggcaacttggggtctcaggtcccagctctgggttacgtagggaacgtcattgcgaccgccaagaacgcctacggtgttgctacagcacccaacaagcctactgagcgtgactacatgactggcctgatgaactccactaaggagcttgtcccgaacgacccactgacccagcagctcatcatgaaaatctatgaggctaatggggtcaccatcaagcaacagccgaagcctaactaattaggacacactatagggagacccaacggtttcccttatcattcaactaaaggaggtcacaatggaccaagacattaaaacagtcattcagtacccagtaggggccactgagttcgacatcccgttcgactacctgtcccgtaagtttgtacgtgtgtcgcttgtagctgacgacaaccgcagactgctgagtaacatcactgagtaccgctacgtgtccaagaccagagtgaagctccttgtggaaactactgggttcgaccgtgtggaaatccgcaggttcacctcagcgtctgagcgaatcgttgacttcagtgatggctcggttctccgcgctgctgaccttaacgtatctcagatacagtcagctcacattgccgaagaagcaagggacgctgcactaatggccatgccagaggatgacgcaggtaacttagatgctcgcaacaggaagattgtcagactggctccgggagaggctggaacagacgccataaacaagaaccagttagatgaaactcttggagaagctggtggcatcttgtcagactttgaggatgtgcgtgatgagattattcagtacatctccaagttcacggatgacaccggggctgtacgcggagtatcttacgtgtacaacaacgggagagcacttggcggtgagactggttttcacatcgatattacaccacctccgctgggtgttccgtacttgtcgataaacggtagcaagcaatatcggggatatcacttcacgtatgacccgattactggtaacgtgcaaggactggcgacgccactggaaaaagatgacttcgtggttgccactaccacagagagcgtaacaccaatagaggatttatacgccagcacacaaggtgcatccatgataggaacattgagtggtagcactgtggaggagcgcatagccgaagtagaacagagcgttcttgactcaatagacggaatccgagttgatagcttcatcgggatgactgatagcggtgcgatagatgcagccatcgcagaggccctccgagtaaatagctacgtcaagttttctccacgtgtgtacacggttgacagacctgtcattctcccctctaagacagtgctggtaggaacccaaggccttactaagatagttgccagcgcgagctggaatggcccagtggtgatgtcaaaggatgcacctgctggggactacctgactataaacgtaccgtctgcaatggtgtacggggtgtatatcttcggaatcatcattgagtcgggctggaagggtacaacagacgactcccggtaccacaccgagtgtttacgcatttacggcgcaggaacaatactgaaaggtgttcgtgttggtaagtgtcgtggtgatggggctaatcttggcggtcgaggactaaccgctattgattatggggctcctagtctctattcggatgtacgtgctgacctaattggtaagaatggtataaccattggtggttcctcggacaaccacactcagaacatcgttgtgcgaaacgcaggattattggagcatgacgtttactactgcatcggcatcggtccgggaggtggtacacgcggtaatgaataccacacgtggcacagtggtgacgcccagataaccccgctgtatcaaaacaggcctaaatacggactgtatctggctggttgggacacctatatcaccaacggccacttcgagggtgcggcaagtgctcagatagcaaactttggtggtagaaatcaggtgaccaacgttcgggcctactctacttgggaccaagataagtgcacagttctagttgcaggacctgccttcaagttcgttggtaacattggtgcccctatgaacaatgtaccagctaaccgctgccatgcgttccaactgggtacagcggacatacaggttaaccaagtggaaatcacggctcaggtaaacggccagaagtttgtcaactacgtcaatgctggcggttctaactccattgcagtgcgcggtactctcggtattgctggagcctccggcataggaacattggtcactgggactgttcctgatgataatgaactcacaatcattgctgagccatataaaggtaagcggttaggcttgaacctgatactgacgggagacaagggcctgacgtgtcgtgacgttaactctacaggacagattagcggagtcaatgcgctacttactggtaaagttatgttaactggcctcagttctgatataccaaccactccgggcaccgtgtacgtcgattccaacggtaacctgaaagtaaaactataaggagcgctacatgttagacaaactgaatcagccgaaaggctcaaccattggtgtgctcaaggatgggcgcactattcaggaggcattcgactccctaggctaccttggggtggccgttctttcacccgccaattacggtgccaaaggtgatggtaaagcggacgatacgattccactgcggcaatgcgttcaggatgcgtgcgccttgggtggccgcgttgtcggtactgttggtgctgagtacaaaatctcagggaccattgcgggaaccgtaggagacggtaagtacgttgagctggacttcacaggttctaagtttgtgcccaccactgatgacgctgtcatgactataactggtgttgcgacctccccagtagctgaggtaaccgtcgaggttgtctcggtgaacttaggtaatggctccaccaacacgattgcgatgaaggtaacagctcctggcggacactcattcaccaagaagggtgagattggcaaggcatggtctccggtgctgtgcctgaacaacgacctgtccactcagtatgcaggtgagccgttcgtcgtgggactcgtggaatcgtctacagtgttctacaccaccagcgtattcaccgagttgtacatggggaccagcctcaaggtaatccgagtgccgaccactcaggttgtcgtgaagggtctcgatgttgagtccgagtggactaccggatggaaggccagtacgttgaccttaagcggactgctgcgaccgttcgtgtacaagcctaagtgtaagaacatcaacggaccgttcgtgaacctgactggttgctacggtgccactgtgttcctacctgaaggtgacaacctgcgaaatgctccgtctgaaggtgcctacgggtacttcgtgaatgactcggcgagcttcggttccaccatctacggcattaactgtacgaacgcccgtcatgcgtacacaacgtcttcacctcgtagtgagcctacggatgacaagtggtggttgaagggacgcaccttgttctcagagattaccaacggtctgggcacagggtgccataacgccttcgacacgcactcaccttcttacggaatcaagttcactaactgccgagcagtgggtgacttccgtggtgtggacactggaggggctggcttccagattcgaggagaccgtagctcactggttgactgtacggcgattaacagcaagattggcgctgcgttcacagctgtgaacatctctggtaactctgagttgtacatctcagggttcacctatgagggtccagcaggacacttagcgttatccctgtcaggcaaagctggtcaaatcaaccgtgtaaccatctcggacagccgctggaaaactctggaacagtacgcgaccgctatcaccaacgttgaggtatccgcaagtaacgttgaggctgttgtggactcagcgaccactgcgtctgctgcgtggcgtatcggtgaaggagcaaccctacgtacccgtggaggtgcagctcggttctctgctggctcagggcactccgtgattagtctggcagcgtctggagcaaaggttgatgttggcgacctcgaagtcaccgggtcttccttcatgcagtacctgctggcgaccttgtctcagtacgctggtgatgtgtacatcgaggcagaccttgatggtgcccttccgggtaaccctgtgggtggtggtggtactgaccttaaggcggctgtagtgtacactgctggtaataagttccgtcgacctctggcctaccgtgcgttgactattggtaacgccaacggtaacactctgggactgaactactcaggtcacgatgttatcacttgggaaatcacagcgaccgtcgcgggagctaacgtcaacgggattactccgggtgcattcattgggcagcagctgaacattggtagctccccagcaagcactcagcagctaatcatcaaaaacggcaccaacattgcgatgggacacgcagtcacccttgaggctggccgtggtgttaccttgtactggaacggagctaactggcggagcggttccgtctaactaaggaggtaacatgttgtccctagacttcaacaacgaagttatcaaggcggctcccattgcgggggtcgctggggccgatggtgtagcgaggctcttctggggcctctcactcaacgagtggttctacgtcgcggcaatcgcctacacagtggttcagattggtgccaaggtagtcgacaaaatcattgactggaagaaagctaataaggagtaacatatggacctgattaagttcctcgaaatgttagacactgagatggctcagcagatgctcatggacctgaagaatcccgagaagcggacccctcagctgtacaacgccattggtaaactgttggagcgccacaagttccaaatctctaagctgacccctgacgttaacatcttgggcggactggctgagggtctggaggcttacaactccaaggtgggtgctgatggactgacagatgacgataagttcaccctacagtgatatactcaaggtactactatatgtagtgcctttatggatgtcattgcactacgctaggcgttcctacgtgaaatctgagaaacaacgggaggcattatgctggagttcacaaagagaatcgtcccgtatcttgtggctatcatggtgtttgccttcgggtggcacttggggtcacaatctacggacgctaaatggaaggaggtagtacagaatgaatacgttaagaagcaaacggctagagctgaaactcagaaagcgattgacgcagtatcggctaagtaccaagcagaccttgagaggctggaaggcagcactgataggattattgctgatttgcgtagcgacaataagcggctgcgcgtcagagtcaaacctaccagtgtcgccgcaggaccagacggtcgatgcctcgttgatggttccgtcgaactacacgaagcaactgctcgaagtcttatcgcaataacccagaaggcagacctaaaagagaaggccctacaggacacaattcgtaagctacagcggaaaggaggtgaacattgagtaactctcagcaagccaagaacgccttaatcattgcgcaactgaagggtgactttgtcgcctttctcttcgtgctctggaaggccctgaacctgccggaaccaaccaagtgtcaaatcgacatggccaagtgtctggcagaccccaagaacaagaagtttatccttcaggctttccgtggtatcgggaagtcgttcatcacgtgtgcgttcgtagtgtggaccctatggcgtgaccctcagttaaagatactgattgtctcagcctcgaaggaacgtgcggacgctaactccatcttcatcaagaacatcatcgacttgttgcctttcctaagtgagcttaagcctcgccccggtcagcgtgactccgtgattagctttgatgtaggccctgccaagccggaccacagcccgtcagttaagtctgtgggtattacgggtcagcttactggtagccgtgccgatatcatcattgcggatgacgtggagattcccggtaactctgcaactcaaggtgcccgcgagaaactctggacgttggttcaggagttcgccgcactgttgaaacctctgccgactagccgtgttatctatctgggtactcctcagaccgagatgacgctctacaaggaacttgaggacaaccgtgggtactccaccattatctggcctgcacagtatcctcgctccaaagaggaagacctgtactatggcgaccgtctggctccgatgctccgtagtgagtacgatgaggacaaagatggtctcggtagtcaacctactgacccggttcgattcgactcaatggaccttcaggaacgtgaggtggaatacggcaaggctggctatacgcttcagttcatgctcaaccctaacctcagtgacgccgagaagtaccctctacgcctccgtgacgctatcgtgtgcggtctacagatggacaaggccccaatgcattaccagtggttgccgaaccgtcagaaccgcaatgaggagcttcccaacgtgggcatgaagggtgatgagatttactccttccatacagcctccagtaacactggtgcgtatcagggtaagattctggtcattgaccccagtggtcgcggtaaggatgaaactggctggtgcgtgctgtacaccctcaacggttacatctacttgatggacgctggcggtacccgtggttacgaagagaagtcccttgagttcctcgctaagaaagctaagcagtggcaggtgcagactgtggtcttcgagagtaacttcggtgacggtatgttcggtaacgtgttccagcctgtgctactgaagcatcacccagcgcaactagaagagattcgtgctcgtggtatgaaagaggtacgtatctgcgatacccttgagcctgtactggcaagtcaccgcttggtaatccgcgatgaggtcatccgacaggactaccagacggcacgtgatgcagacggtaagcacgctctgaagtacagcctgttctaccagatgacccgtatgagtcgcgagaagggcgctgtggcacacgatgaccgacttgatgcgttggcattgggtgtcgagttcctacgctctacgatgcagcaggacgctgtgaagatagaggctgaggtacttcaggagttcttggagcaccacatggagaagcccctgagcaacatctcccagttccgggccaccagcagcaacggtgtggacatccgatgggaagacgatggggatgacactatgttcatcgcatggtgattatgcagggattgtgcataaggattcattaggccacggaaggccacttcaggaaaacttcaggcataacagacacttggaattagggcacactatagggagagacccttgaagacttactataagactacttaaagtttcattcatatagttatgcactataagtctccttacaggtagaggtagtgatgataatatcaccctctcaccataagacactaagagccaacataaggaggacctatgcgcttattgttaaccttactgcgccataggactacttggcgatttctgctggtacttgctggtgcccttggggcttcactggttactcagcagcaactcggtggactggagactctcgtgtgctctctactcacttgtagcgattagggtcttcctgacgtgctagggattccgtagtgatgcttatcagcatacaccactccatccctctatagtcaatacttaaagttaaccttaggtgattcactgggtctacctatgggtctgtacactgacctgaggaatacctgaggttacctttaagaatattgcataaagttctgagtgtacatctcacagtttacacttttggttatccccccggtaccctccagttcacccaaagtaaccatgggccaccccttaacctttggttaaaccttaggtgggaccgatgggaatccttaggtgatactatatgttgtggtgtgggacaccttgggatactatatgttgatgtctctgtgtccc

SEQ ID NO: 100 - DNA, 43683 bp, Bacteriophage A13-K20-1
tatcgaagccttaaaagcggccctggataagggtggcgatagcgctaaggagcagccccaggagctggctaagacaggcaacccgacgattgacgccggtgtagctatgttgcagaaagtctctgggttaactgactctgatatggtgcgggcacttggtaaggccctggagtatcaggaccctaacctaatcgatacggccttcattaaggaacgtttcggagagcacgctgcttatgcagagttgctggctaaagcgtacctggaagaccaggttggccaagccaccaaggcagtacaagaagcttacgatatcgtgggcggtaaggagaactgggaggtagcagcgcagctgtttaattccaaggcccctgaacctctgcgtaacgcagctcgtgtactcgctaactcgggtgagctcaagcaggccgctgagctggtagcaagcttctgccgggatatgggtcttatcaagacacagaacccaatggtacgcggcgtagccagcaacaatgcactgtctgctgcggaattccgcgcagaatataccaaactccgtcaggaagcgggcaaccgtagcttggcgtctacgcagttcagtcaacgttataacgatttgctcgcacgccgtgaagctggtaagcgcgtaggtctctaattttacttataaaggaaactaaagcatggccaacactatttataatggcaacctgactcgtccgcactggggcggcgcagactccgacgtagacgttcacctggaagtgtaccagaacgaagtggatacccgcttccagtaccaggctctgttcctgggcctctccagccagcgctctatcagcggttccaacacctaccgtattgaccgcctgaacacctcctcggtgaagggtcgtcgctctggtgaggcgctggatagcaccccggtccgtaacgataagatgattatcgtggtggatacggtgctgtatatccgtaacccgattgactaccaggatgactggaccggcccggacttcctgaccgagatgggtcagaacaacggctctgagttcgcagaggtcttcgaccaggcgcacctgattcagctcatcaagggccgttcctgggttgccccggcgcacctgaaaccggcgttcaatgacggtatcgaggtgggcgcagctatccttgttccaggtggcacctccgccacgcagctgactcaggctgagatggaggctaacgccatgaacatcaacctggcgcacaaggctggtattgatgagctcatcaagcgcaagaccccgctggcggatatggtcactctggtggatgtcgatacctattcgcgtctgctggagcatccgaagctcctgaacatcgaattcggcccgtccaacaacgacggttacaaagaccgtcgtgtagtgaagatgaacggcgtgccggtagtagagtgcaccgagttcccgacctcggctggtacgcacccgctgggctctgcttacaccgtcaccgctgacgacgcgctgtgccgtatggtgactttcagcaagtccaagaccctggtgactgttgaagctaagccgttcacctcccgtatctgggatgatgagcgcgagttcagcaacgttctggactgctacgcgatgtacaacatcggtctgcgtcgtccggacaccgctgcagtgaccaagttcaccttcaccaccaagacggcctaattggaggttcaatggcagtaatcgctatgttcggtctggagactctccaggccaatgcagctcagcgggaggcggttaaggccgccaccgatgtagcgaagaacatccaggtggcttcggttgaatctggccgcaaggctaccaagaaaacccgtaaggcggctgaagtagccgctgatactgtggaagagtaatacgcgcccctggtgccttcgggtgccaggggctttttttttgtccctgtcttaaaggtccaaggggtctttaatagaggaacaaatatgagagaattactaatgtacgaccccaccagccccagcggattgcgctggaaggttgatgggtataataactcgtacaaagccggtgatgtcgctgggtgtacacattcaggggccaccggatactaccaaatagttatccgcggtaagaagtatttaagtcacagagtggtgtactttctagtgtatggagagtggccggatactgtggaccacataaacggtaatcgcaaagataaccggatagagaatctacgcgcagccactatgcgccagaatctgtgcaacttaaccaaggccagagggttctactttgccaagcagcaaggaaaattcgtggcacagatatgcagtcacggtaagaatagaacaattggcagctttgatactgcactagatgctcgtgcagcgtaccttcgcgccaaacttgaagagcacggtctcgtgccgggggtggtttattcgtgaattagatgctgtgaacctgacgctggaagcccttggggagtctcgcgttatggacatcaacactagtaaccctagcgctggattagctcgctctgcactcgcacgaaatcgtcgtggactgctcagcacggggttctggtttaacgtggtagagcgtgaggtcactcccactgctgatggctttattaaagtgccgtggaaccaactagccgtgtacgatgctggttctgactctaagtacggggtacgggacgggaatctgtatgacctgatggagcagaaccaatactttgacagctccgttaagctcaaaatagtcctggacttggactttgaggacctaccggagcacgcggctatgtgggtggcgaattataccactgcacaggtatacctcaacgaccttggcggcgacagcaactacgctaattacgcacaggaagctgagcgttacaagagcatggtgctgcgagagcatctgcgcaatcagaggttcagcaccagcaagacacgctttgcacgcagaatccgccgcgctcgttttatggtttaaggagaggttatggcgcaatcattagaaggtactattcagagcttgttgcagggcgtttcccagcaggttccgagagagcgccagcctgggcaactgggggcgcagctgaatatgctcagcgacccagtttccggcatccgccgcaggcctccgggtgagattgtatgggagagtacaatcgataaccctgggcttgattccctgttcactgaatacgtagagcgtgggactgacggtaggcacctgctgattaacaccagcaacggtaactggtggttgctggctaagaatggaaagaccatcctcaactccggcaatgacccgtactttgttaccaccgtaggccagacttctttgcagaccgcaagtattgccggactgacttatatcctgaatacggagatggccccaagcacgaccgtggacaacactgggcgaatcgacccaagcaccacggggttcttctacgttaaatccgcagcattccagaaacgttggaatgttacagttacatctgcgggggtagattactccggggactactccgcaccggctgctggcagcactagcggaaacgctgaggaagtatcaggtgcctacgttgctcagcagctgcgagactcactcgtagcgaacgggttaccagctgggaacgtgagcgtacgcggtgcgtacctgttcttctacgggctaagcaactgtgtggtatcctctgacgctggcaatacttatgctgtggtatccaaccagtctcgtgtagaccaggagcaggacctgcctgcgcagctaccagcagaagctgatggggcaatgtgtcgtgtaggtacagcttcttccgagacagcatggtaccagttcgattacagtacccgcacctggtctgaggtgggggcgtacggcagcatcaccaagattacgaacatgcccagagagctcgccgcggatgataacattattgcgcgggattgggaggggcgcttagcgggcaacgacgacaacaacagcgacccaggattcgtcgagaatggatacatcactgggattgcagctttccagggccgcctggttctgcttagtggtagctccgtggatatgtcggcctcgggcctatatcagcgcttctaccgctctactgtgacgtctatgctggacacggaccgtatcagtattagctctgcgtctgcgcaggattcggtgtaccgcactgctgtgcagttcaaccgggacctggtcctgtttgctaacagcatgcaggcggttgtgccgggttcggcagtacttacgccaactaacgcaagtattagtattaccagcacctacgattgtgacagccgcgttaccccggtaatggcgggtcagacagtaatctacccgaacaagcgcaacgacagctacgcgggtatactggagctaatcccatcaccttataccgcggcgcagtacactacgcaggatgccacggtgcacctacctcggtatatcccaggcagggtattgcagatgcaaaactccagtgtcaccaatatggccttctcgcgcatgtctggagagcgtaatagcctgctggtctacgagttcatgtggggcggaagtgatggcgctaagatgcaggcagcgtggcataagtggtcgttcccgtatccaatcctgagtgtacaggcgctggaggatgaggtgttcttgtacatgcaagggcccagtcccagcaacaagcttttgattgtgtctatggacccgcgtgaaggttatcagctgggctcagaataccacgaagcctactcggatttgcagaagcaagttcaagtgcaggacggggtgttcactgttccggctgtattgcgcccggttggatgggttgacaattacaaggaagagcttatcctaacgtacttacccagcaaccctatggggcctactgaggttggcatcaaggagattgccggggagaacaccctacgggttgtgcgcggcgtacctgatggcacttatgtaatcgggagacgttatcgtagtacgttcacgctaactacgcctattctactggaccagaatgacaagctcgtggggagtgggcatgtgcgcctgctgcgtctggacgtggcagtacgtaactccgggcacttcgacgtacaggtactagacaccccgcgggacgtcaattggggtggggagctaactggtatcctgatgaactcaaaggagctgacgcttgggcaggccctgcgtatggacctggctacgcttaccgtgccatgtcgtaccaacgcagacacaaccgaggtgtcactatttactgacggttctatggaactgaacgtgttggatatatcgtacatcctgcgctacaaccaacgcagacggaggatttaatatgtggtggatggttgcggccatggccgctaagaccgttctggggcagggtgctcagattgaagtgtccaaggccaggaacaaggctgtgattcaacagacagccaaacagctaaacgacatcgcgctacagcgcgcccagtccagggaccggactgaggtgtctctgtttaacattcagcagcagaagctgcaggcacagagccaagtaggactgcaggcagcagcttccggcactatgggagcctctgttaaagacgccgtagccacggtgaacactgtagccgggcggcaagaggccagcgtgcgtgaccagcaggcaactcaggaagagggcttccgtctaatgacagataaggccgtggatagcggcctggctaacatggatatggaggacccgtacgataacatgtttaactcgctgttgggtgtcggggcatccgctgttgggcagtacgccggtaacgctgcgtcatcttctgactctggcagctcttcgcctgggagcggagcgtcagctacacagagcatggcatcctcctatgacttatgggggagtaagggcaatagcccagttcacacctggtaaattaggaggaatactaaatgcctgtgattcaaccaagtagacaggggctaaatatcggtggcgtgcaactgcaatccaacgatgttagcttgccgtcaacggtaagtgaagtatctgttgatacctccaaagcaaaacgcctagccgccctgtctggattcgtgcaggacttcggcgtaggtttcgacgaggcagtaaaagaaaacgccgcagccgccaccgtgcgcggcgctatggatgctcagggcgcagtagatgcaatggcctccaaggacgaggctgtacagaagcaaaacatcttcgtgcgcgaagcctaccaggacggctacgtatccgccgccgcgtacgacactctagccaagtggcgcacagacagcatcgcccgggctaagaaagctgccgaggcagggctgactgacgaggaattccagcagcaggagcaagagcacgtacagtcaatgtcagacaagctagggatgtatctcccggatatgtccaagcagtctgctacgagtatactgcagcagctccgcgctaccagtatggctaactatacagccttccagaaaggacgtgctgcgttcgccctggcccaggctgaccgtgccctcgaccgtggactgagtacgtccggcgacgagttctatcagcgcctacaggcggggcagggtgctgctgcgcagatgtccattaagactggcttagacagtatcctggctgctgagcacctggacaagggcaagaagctagaccgggccaagcagtatctggtcagcgtagcgcagcagacgcaggacccgctggtaatcaaccagctacaggaactcgttaccaaggaacttggtgtaaacgccgtagacgttaacgcagcgttgtatcaggaatttaagcgcgccggtgctcagattgagacccaagctcgtttcgaaatctccgatgcaatccagtctcttgaggggcagaccccagagcagcaggaacagactatgcagcgtattcgtagtcgtgtcattgagctgtcggcgtcggacgtgctcagcgctggaactagcatggagttctggaacaaggctcagactgttcgtgagaaggcagccgatacccaggcattgcgcgccgcgattactggaaatatgccaagctctaccctggctgggatgtacaagggcgacttagataaggcgcgtactcagctgctcaagagctttccggacaccccggaagggaacctgcagctgctggcatatggaagcaacagtaaggatgcgtgggcagtcaatgaggcgcacaagcgtatgtcttcggacatggcgcgtacactgactacactggaccagctcggcgaggacggcgaggtttcccgcgagaacgtcaacagcatcaacttgtgggcacaggcttatagcaccagtacggacttagggaagatggcgctgctatctgaggttccgtcagagtggcggggcgtagtgcaggcagccatcgcccagaacccgagtaatgccagcaacactatcctggatgacctgcgccgccaggcacgcaacaaggccagcggccgctacagcaacatccagagtaaccctacagacaagatggtggaccctagcggcaccagtaactggttcagcttctttggtacagcggatgcgcagcgtcaggaagcgcgtgctgctatggaagaggagtaccgatacacctacagccacaacccagagtcgttggttggtaaggaccctgacgacatcaacacgatgctcaagggtaacatccaagcccgtaagctggagctggatatctctggagcacctcggcatgtgtacctgccagctgggacttctatccaatccctaatgggggattaccgaggggaccaggagcagttcaaggtatccctgcagcagcagattcagaaccaggtcaacgccttaatcgacccaagcaaccttgagcgcgtagtggtgcaggctgctacagcaggtaactccgctcagaacatgaccatcaccaccttcgacaagaagggcaccttccagactatgtctgtgaatctccgtgatgtccaggtagctgcacaggacgcttacgataaggcactgtctggtgagatgaagattggcagtgagcaggtcggtatccgcccagctacgttctacgaccacgacaacggcagagctgtgagcgtacaggtcaacgggcgtaatggggccggtgtagagccttcactattcagtgagattctcgccaacaccatgcagttcgagggattccgggaaggcaaaggtaagggaagcgtaggcttcggcctgcacatcaactccggtatgccggttccgaagaaggttactatcgacgacggtatcagcattctgaaatcctccctggagcagcagtacattccgaacgtgaacaagcagctgcgcgggcagggcttgagtgcttctgcggacgccatgaaggttatggtggacctgaactatcacgggggtaacgggagttcaggcccggtggctgaggctatggccgcagtgcgcaaatcgaaagacagcgcaggggctgcgctatacagcatccctcaggcatctgccgccgctcttactattctaagacagcagcccgcctataaggaagcgcaacctaagcgtaaacagtatctcgagcaacatctacaggcttggatatttgaagtaacgcactaacagaggcccttcggggcctccccttatcaaaattcttttaggagataatatggctcagtttctgaaccaagaaccgaatccgcaggaaaagggttctgctaagggcgcaacacttaaacctgcgcctgcaagcgtagattggaatgacgctgatgatgggggtgtatctgccctagagcgcgcatccttaatggctcaagccaagacccccgcgacttcagcaggggatagctttgctgctggggtaggtaacagcattgtggctgcggctatccgcaaggcctctgccccggcatttatgccagagcagggttttgatgcgaagaagtacttgggcacggattcccgcacaaagctgtatacaccaagtgcagaggaaattgagtatctgcacggagccgcttcccgggaagagtatgattaccgcgtacaggatatgcttacgcaacgtaaccgtgaccggatgatgtcagacaacgtcgctgcaggaatagctggtatgttgctgggggactcccccttcatattagcccccatggcggctgggggcattgctggtcgtaccggcctagcagtgcgctctgctatccgtgctggtgatgtcgccacggcagtgtatgcacaggaccagttggggcagtctgctggggtaacggcactaatagcaggggtttccggtatagaccaactgtgggatatgtctagggcagcaaaggcggcagcaaagctgcgcacagggcgagagcctgcgtttgacccagatgcgcctacaactcgtacagcaagggacactaatgttaccggagtaggagagaggaccctagactctattatggatgaagtgttggctgaacccatcactgtacaagctaagaatgtggcgggagttagcttaaaggcacatcacgttacacagtatctccgcagcacgggtacgttgactcgggggcaagaggtacttttggacgccattgagccagtcgtgcgcgacgttgatttcacgctaatggcgggcactgaccgcgttgtcgctaggagtaagtacacatttaatccggacaaccttacagctcctggtactgtggcgctacgcgcaccggcggcagcggaggggagcacttggaatacggttggtgacgcgctgcgagctgcagacgcagagactcgaggagcagctctgcatgagctaattcacgcagctacctccagagcgctggatgcggacccgagtcttgtagagcgtttaaagccgattcaagagcaccttcaacaaacggcaaaccttaaaggggagctaaagtacctcgcctccgacccgcacgagatgctcgcgggtttagctaacaactcagattgggtgcagcttctgagcagaacgccaagtcaaacagctggtaaatccgtacttcgccagctaggtgaggcggtgctgcaggcctttggtattactgctagaggttcttctttagatgacgtattaaatacatttgaagctgctgttaagtggtccgcagacaacacccgcgctgcgcagtacgagttccgctcagacattatgcgcgaagcggcagagggcgcactaagagaacagcacgagttcttaaaggctaaagctatgatggaaggtactaaaaaggctttcgctagaaacttcgccctgtatgataacatcgctcagggaagtgaggacctggcccgactcctggtatctgacgctacttcggttggcgcgcgccgtccatctgtggtggattataagcgcaacctaacccttgagatggatgccagcgctgtcattgtggaagacgctatactgagtgcgttaaaggctcgtaacattggaccgctatctaggttcttccaccgctcaaatttccgtgcggcccgtgcggatttagagtcccgcctgggacactacttggactccgcatatgatgcacagttaaacggaagggcagtacctgtaccagaggcggatatagcccccctggtggaagcatataaacgctctgggtgggccggtaggtggcacgaccatatgagcgcagcagggcttctggatgatgcggatgtcttaaaatcggactactacttcccgcgccaatatagctacgacaagttgcgccaagggttattggaaggcagaactctggacaactaccgggatttattccggcaagccctgcgggatatctaccccaacattgaacctgaggttgtgcagcgggtcgctaaagaaatggtggatggtatatacaacggtagggccgctggtcgtgggcctatgtggaggcagttgattaatggcatgagcgaagatgagctgcttggggctatgcgtaatgcaggagtctctgatagtgccattaacagctttgctgcagctaacctcagaagctcaggggccacaaacccggctaggaacttacgtcaccgtaaccgctttaatatgagcaaggagtacatggttgacgggcaggctatgcgtatgcaggacctgatggatacgaatgtacctaaggttatgcacggctacactaatcgcatgtctggtagggtgggtatggcctacgcaggagtgtccgaccttaaaactctggaaaccatgattaacgccagcaagcactctgtggctaaccctgaaaagtgggagcgtgtagtggatgacactatagacttcatactcggagggatgccggcagatgcaaacttaccggatatgcttcgtgctgcgggtaatattgcaaatgccaccatgctaaagaactccggactatatcagcttaccgatacagctttgtcattgaagactttcggtatgacacgggtagctagaagtatggcggagcaaccctggtttaaagaaggtgctgtggtgtttggctccaaagatatgtccgagcgattggactctattctgcgcggcggcgtacaaagggatatgcgttttcgttggttcaacacctatgcagacgacaaccttgacttaactagacaagccccttggttcaacgtcacgcaaaacgtaggacaggcggcgcgtcacgttaacggcatgagcatggtgcacaggttgcaagtgaacctaaactccggcattgtagcggacgaactcaagcagatgttcaagggcgactccgaggcattcaaacgccttgagaagttcggcttggacagagatgtggcggatagagccattgcagcagagaaggctaacccaggcgcagtatttgacccggagctgcagatgcagattgaggttgtaggggtgcgtatgatggactatctggtacagcaaatccgtaccggtgaaacttcacacttcgctcaattcaacccggtgggtaagcttatcgtaggctttcaaagctttgctgtagccgcaaccaacaagattttgcgtcgagagttgaacgatgctgggtggattgggttggcgcacatcatggcatatcaattcccattaatgttgttagccactaaggctaagcacagcatggatggaaaggatacggatactcgcagactagttaaggaagctgtaatgggaatgagcgccattggtggtatctcgcttctgcaggatatcttcactggggattcaccgcgtcactcgctggcgtctatgggttacgtcacaggactgcttggggccgtacaggacctggttaccggtaatatggatatcaagaccttcactaagcaggtaccgttaatccaggaattcgcacctacgcgagctattattaataactttggagacgactaatatggcgtttagctggcaagagtctacagtggcttcgggtactcagaatatcacgtgtgaccttgagtacttagacaagtcctatattcacgtgtacctcgacggtcaggaaactactgcgttctcttggaccagcgacacggttattcgtctggatgcagcactaaccgcagagacggtggtgctgttaatccgtaagacggaacgtgaatatctctacatcatgttcgctagtggcgcgccatttattgaggcgaacgtagatacccagaacaagcagttcctgcatctggcccaagagctggtggaggggcgtgctatcgagggcttctacggtgacataagctttaacggataccgtatcactaacgtaggcacaccagaagaggataccgacgctgctaacaaggcgtatgtggatgctacagtccagagcgaggcagtgctgcgggctgcagcagacgccaaaattcagcaggatgttgactacaacgaattaagatccttgcggttcccagagggcgtggaagaaatgcccggggtgacggggagggctaacagcctgcagggctataatgatgcaggtaagcctgttcctatttttgacatgacggccacagcagatttagctatgaagttggcttcttctggggacggtttaggggcaggtctagttggttatgacattgccagctcctactcaaataatacagtgggaaagaagctaaactttctgttatcgccgtgggacttcggagccgtggcagatggtacacttcaccctctctctgaatactacaccaccttagcagcagcacaggcggtgtatccgtttgtgactagtcttgaccagtctattgactacgcggcaatgcagaagtgcgttaacgcgatgattgcccgcggtgctgctgggatgactatgggcggccgcgggcggttctgcatcaacagcacggttcagtttaataaggccggctctgtaaacgaagccaacaagactattgacttctccggagctttgattgagagctactgcggtgctcaggttcttaacgacaccatcttcacctcgtggactctgcaggggggcgtaacggttgacagcggtacgctagtattcgccggggacagcaccactcaagcccaggccgcaatcacccttactgggttgactgtaggcaagagctacgccgtaagtgtacgcatcgagacgtacaccagtagggggtatctgcgcatacgcttgaatggtacacccattagtcgcgccaacgaggctgggccgggggtacgccatgcggagttcacggctacagctaccactcacgtcctgcaactccgagatgacacctggactagtactcctgctcactgcattgtaagcgaggtggacgtacgtgagttggcttatcccctgcgcttctaccagctagggaccgcaatcacccacggcagtgtagccgtgtataacctgcgtatatataaccgcaactcggcgggcttcggcgggcttcgtgcagacaatcttaaccacgctgccttcaacggagtgacttcctttgttgggttctatggaccgggtatgcatatgtgcaacacgctgtcttggtctgagaacgatacggtggatgtgctgttagcggccaactgtcgtgaggcggttcggtttacgcgcccagtggctggtacaggcttgaactcttacgctcgtacgaatatcaagcgcatcgtgtttgctagttgtcggtatgccgccgtgtttgaagtgggtacttccgtgtacgattccgtcattgggtctgtgagcgggaacctcacctccaacttccgcgccatcttctccctgcacggggatcagtcctcatctgtggtggagtctatccgcgtagagaataactctgcaccgagtactgcaggtatcttcgagtacggccttaacgacctgcgacgcattaacttgcgcgcagtggggttctacttgggtatccctttactcgcgacaaactcctgggctgctggtactgtgtcgctggagaacaccatctccggtacagacttcagaccggcgcgtccgtacttcggtgccaccgtgcacctgccgccgtccggtaccctaggtatcggtgcagtatatagtgcaggtacgtacacctggagtgaggttctgctcgcagtggagccagctacggctacggcaataggcgggacgtacagcttgacaccggcacacggtgtggttgagctggatattagtctgcgcaacgctgacgggacctctatgcagggtacgaagcgtactattaagctgatgaaggctaccgtgtttggtgcggatgtctctaaggtggttgtgtacgactcagaggccccggtaaactcagagttaattacaattacgtggcctgctaactccgcaccgctaatcacgcacagtgcggcggcggcacggtctattcaggtatacgcaaggtggacagtataatggagacactaggacctattaatcggttagcagacttcgcggggattggctccgcgttgctgcagccgtacctgctaagtagcagctccgtgccagagctgtgtctcgcctttcaatccctgggggatgatgggagggcatacgctgtagggacccaggggttcttgtatgactacatgcactcatggctagtacgggacccggagctgttggagctcattaatgagtaccgtgcgtccaacggtgttccggtattggaggaataatatggcaggggcggctaaacgtagtcgcctctcggagctgcaccgcatgttcactgaggccttgattgaagaaatcaagcagtctaaggaagatgaggtgccactccccgccgcagataaatcggttatcgctaagttcttgaaggacaacgacatcaccgcggacgcagactccgaggagatgcagggccttcgcgacgagttcgatgacgagctagcggcgcgcagagaggcgcgtaagcaagagattctaaataaagttggtggttcagactctgaggacttactagaaggaattgtctaatggtatcggtgaagactgcgcgaagactgcgcatgctcaaccagaaacttactggttatagtgcgaatccgcgcagtattcccaaagaggagcgcgaggacatcgcgatgatgatggccgctgcgctaagtgacttccgagaatttgcgtatatcggtatgcggttcctgggttttacgctcacggacatgcaggccgacattgcagagtacatgcagaagggccctaggaagcgcatggtggccgcacagcgtggtgaggctaagtctacgctagctgcgctctacgccgtctggaggctcatccaggaccaatcctgtcgtatcctgattgtgtctggtgcagagaagcaggcttctgatgtagcgaacttaatcattcgtatgctggaaacctggccgctgctatgctacttgaaggctgaccctactcgtggggaccgtacttcattcgaaggttatgatgtcaactgcgacctgaaaccgctggacaaatccgctagcgtggcctgtgtaggtatcactgcatctctgcagggaaagcgcgcggacctacttattccagacgatatcgagaccaccaagaatggtttaacgcaaacccagcgcgagcagctgctgatgatttctaaagacttcgcagctatctgtacgcacggggatacgctataccttggtacaccgcagaccaaggacagtatctataaaaccctgccgggacgtggcttcgaggtacgcgtgtggcctgggcgcattccgtctgttgaaatggaagagcgatatggaagtacacttgctccttatatccgggagcttattgagcgcggctataaacgtaccggatttggcgtcgacgggacgctaggcgagagcacggacaccgggcgctatgacgaggatgcactgattgagaaggagctggacttcggtccagaaggcttccagctgcagtacatgcttgacaccaccctgtcagaccagatgcgtacgcgcatcaagctttcggatatgctggtttactctggtagccaggactcatccccggagacgttctcctacattgcagaccgccggtacctgtaccagcatgagcatgaggggattatgggtcagcagatgtacttcccggcattctacggggatatgcacctgccataccagcataaggtgctggtggtggacccggctgggtgtggaggggacgaagtatcctacgctgctggtggtgctgcgaactcttacattcacctattctccgtaggcggcttccaaggaggtattagcgaagagaacattgataaactgattgacctgtgcgtagagttggacatcccggatatggtggtggagagcaacatggggcacggtaccgtgtctatgcttatcctgaaccggctgcgggagcgtcgcctagccggcattggcgtaagggacctgaacaactccacgcagaaagagcgtcgtatcatcgacacaatcagcccggttactcgtcggcaccgcctggtggtgcatgagcgtgctattcacgacgatattagcacctgtatggcatactcccgcgataggcgctggttgtactcagcgttcgcgcagctgtccggtatcacatacgaccgcggtagcctggctaaggatgaccgagcagacgcaatagccatgatggtggctacgctgaacgggcatctggtggaagatgagaaggtggtggctgagcgtgagtctgagaagatggctcgggccttcattgataaccctctggattgggcgcagagcaaagtgtctaagggtcttcggggtgtggctgccaggttgcagaaccgtggcagaggtaaacaatatagaggaagaagataatggcatcaatcattgcagctaaaactgcggacgtacagtacgccattgtaggcacgtgccagaacctggagaagcaggtgcagccggactacaacgtaggcttcgtaggtacggctgccctgactaagctgagcacgttcttcacgtacatgcagtcccagggctatacggccacccgtgccggtaccgccttcaaggatgatggtacgttgcaggcgcgcctgttcagtatgctatcgcagctctctaagactgggtacgtagcccttacgggtacaggtatgcccgtaggtgagggttctggtacagcgtttgatgattcgtttactgcgctgcaaagtgcgttcatagccgctactgatgcggcagaataaggagagtacacatggcaattgcaaaagcaacctcagcgcaacagcaggagctgctgcgtcagctgaacattctcggtaaggacctgtatgctatccttacgcagcctcagaacgttgcccagactggtgcagccttcgataccaagattgctgcgcttgaagctgcggtagctgcagtgaaggctgctagctaatgcgtaagctggtcgctgggttactgctcgcggttactctgactggttgctcggcgacctctgcactcaccggcttagttggttctaagccggatgtatctgctcaggttggtgccgagaacaccaaacaagccgttggcttaaataacaaggtggactccagcaccaccaacaaaaccgatgtatcagattctaacgtaggcactttggacacgtccagcaagaagcaggtgcaaactattagcaccgggacaatccaggcagagcgcctacaggtggttaacaacgatagttacagtcttatcctcgccggattagctggggccagcattcctctggtcttcctagtggtcattctggtgattcgtaagctgttcaggaagaaggggcagcaggatgattaaggtgggagacatggttggggcagacctcgctacccgggcaggtgcagcagttaccggcgctacggtatcaggaggttggttggcagagttaatgagctggaactggagcactatcagcttcatcactgcgacggtgtgcgcggtgctaaccctggcgtggaatgcgtattacaagcggcgtacattcaagctcctagaggagcaggcacgtaaggggactattaaatatgagtttaaggactaaggttattgcggcccttatgggggccgctatgctaggcggcgctattaccggggtggttcagcacagcgaggggttgagccttagcgcctacaaagatagcgccgggatccctaccatctgctacggcgagacaaggggcgtcaaaatgggccagagagcttctctgagcgattgtcagaagcaactgatacagtcagcaggggaacacgcaaaggcccttgacgggcttcctatgcagctctctgacgtagctctggttgggtcagtagacttcatttataatgtaggcgtagctggcttcaacagtagcgccgtgaagcggcatctcaagggcctggattatgcagcggccggaaaggctgtactggactggcgctatattagcaagtaccagcagaagtccccgggggccggttgggtgtataagggaggcaaccgctggaccttcgattgctcccagtacattaacgggcagcgcaacagggtgtgctggggcctgtgggagcgcaggcagtggcagagcaaggctatcgggaaccaatataagaatgtacaggttgcggttacagcgctcacggggaaggctcctgagaagtcctagtgaagtactcgggaagccctggagaagcactaggggggggggggctatcctgggtgcacgtctatacctggacccaaaatttattatactcacacaagcccctccctcaccctcagcgcgcccaattgcccccatagggggtgcctagtgccaatttagggggggagggggcactggtggggccacccagggcgcaccagagcgcctcagtggctccctgcgctgcgctagggctatcactagtgctaccctatggctgtccctgtgcgctcactagggcgctccctgtgggccataggggcgtgctctgccttgcttattttgtgcacctagtgggcctgcctagtgcctgcgtagtgggccagctagtgcgctgtagtgctatccctagtgctatccctagtatgcactaggctatacactggctatcctcagtgctttacatcgtgccgattctgtgctacgctgcgcgctccccactagggcgcacttccactatccggcacactccagcgctatcccagcgctatccctttgctcttactttcattcgaaagttattatgaaatgaagtaaccggagtaggaggggtttagggacactatatacactactactcactatgcactcactagtactcactagtaatgccctgtatgaccgaccgtagggagggaagcattacctacccattaactagcctcatagcttaaccgctcccacagcttacgctgtatggtcgctggctatgagtctactcaacactttgtagtattggttcgtactggctagcagtggctacagctagtgccagcatagggctatccctagagctatccctagcatggctctaagtgtttgtcctgcttaccctttttgctctaagagataaaaagtttaaaaaaagtacttgcttcttttggttcaatagggctatagttcaatcaccgggaggcgctgaggtgctaaccggggccgagccgggaggctccgctggattaaagctagatagtgtgaagggttagacactcgataaaaagagtcggcaccgcgaagaacataagctagattgaatcccgaagcaagtagtacagagtaagcagtaagaaataaacgcttgacaagttctgattcactgagtaacttagatagcgaacaacgtagtaagctggtttgcggggaggtccagcaccttgactggtgcgatgacgacccatcccctagacaatcagcagtagcaaagatgtaacgtcaagagctgagacgacaaacggcgggtgcgcttagatgattgtgccctgaaaacgaaatcatcaagcccagagcgactggggagccgggggaaaccacgaagaggctgaatcaacgcggttgtacaggtgctgactagaatcagtaacccgccaaccaataacactgacctaagcaatcatgcttagctgagtgttatacaggagcaaccatgagtaggctgatagatgctgaatataggtggcgcagacaaaacgcaaccgcgtggaggaagcgcatttcggtactggaaaggacaatagagcacttctctgcgtcgcagagtctcacccctaatcaggtaacggcgttagtcagtatgcgtactgagattgccagactgaaagggcacataaaggcgggaacatgaaataccgtgataagttgaaacaacaattcgctgggttggagaagctatccggctccgagttgagaaagcgccgggacgcattgaaccgcgccgggtatatgcggacaaagcaatccgctacattcagtacgaatgtacgcggtaagaccaaaacaaagggcatcagcaaagagcccaagggctggtacactgtgaactcacaattagggggttgattatgaattacgccatgatgattagcacggtgcttgtgctcctgaccgttgcggttggctgcatccggcaactgctgcgggagcacaaacaaaagcagggtaagtaattgcagcctatagcatcctatggggtgctatgtgaagtaattcgataagtaaacaaccaatcaacgaggtgcattatgactaactccacccattcaactggtaaagtattcaagctcaccgctgcgggcagcattcgcaaagcgcttggcgacgtagtggaagcaaagcgtaacatcactatcagcgcgctcttccacggcctgattagcagcaacgtctcatgggctacggatatgcagcgcagtgatgctgctgacttcgatatggtgctgcgcacgctgttgcctatcaagttcaataaagattccggcagatatgagttcaacgcgaagaagtgctatgcgtcggctgataagctgggcatcgaactggacactatgcgtctggattacaaacaagcggacaagcagggccgcgaagtaatcgtagccagcttctatagctcctgtatggccctgtacgatgccacggcagagcaaattaagaacgacacgctggatgccgatgcagtgcgcctgcaagcgctggggcgcgttaagaacgccatcaagaaggccaaagagactggcgtaagcgatgctgaccttgtgtctatgctggtacagcagggtgtggacgtacgcgctgtactggacgcaactttgaaggcggcggcatgatttataaagtaccggttatcaagtggtgggccttgtgccctgcggccaacgatgccgacgccttcgatatccctatgcgggcaatcgctcaaaaatgggtgtacgagggattgggtgagtacgtatagtagcaagcctatagcgtcctacgggggcgctatgtgaatgcaactagcgtatgaggtttcatatgaaagcaatactggtctatccgggccatgaactctggcccgtgtggtgcaatcgggtatacgtagaatacaactacactgtagttatattctctgacaaagacactaatcaggaatcccctttagaatttgtggatacctacaccgaaatggctgcccgcactgtgctggacgccgtgaatcttggcattatcaacgactggagacaactctatggttaatgtattcaacatcattgtgaccagcgctatgctggtgctgggcaacgacgtaaacaacccggtgccctattgcacagtgcagttgcagcaacccgcaacgcaagaaccgcagccgcgccctgagtacgacctattcgaagaccccgagggtggttgtaaagagctgggcgggcgtatccttgaggcagtgcaagagcaatacccggacgccgccgtaacgctcacggtggacggtaagagcaacaacgatatttgaggtagtgtatgcacggaaagaatcctgagacgctgctgatgcgtaagcagcaaccaacaatcgaagggctggcgcgcgagtacagcgctaaggcagcactgcgccagcactatgagaagcaagcaaagcgcctgggtatgaccctgcgcggttactgcttccgatttaatgtgcggggtgtagtatgaaggtgtataccttatacaaggtaggtgcggctatttaccgtatacccaacaatggggacgtaatgcagtactggcacagtgtgtaccgccggtggatgcctgcggttattaatacaacttggagtgtccggatgaagggtaaacttcttggccgcaacgtagtgttcaaggacggcgtatgctaacagtagatgaaacagcgctgctgtgctggcgtctgctggaaacgcagggcaagtgcggctgcacttgggaaacattcaaagaggttccagatgaaatcaaagaaatcgtccctgttgagcgacgtacacttagagtgcgcaagcaggattcaacggtggtgctcacaacctatcgcgagtatacagaatctgccgcgcggcagttgcaagggcacattcagtttgatgtggtcgcggcgctgctacggcacggatatcgtggagcctatacaagatttagggcggctgtgcgctcatattataagcagcgacaactcgctgcgtggtatgcacgctgagctattaatacacgactcaatacaattaactcgggagcaaatgaaaatgcaagagactaacacagcacctatcgaatggaaagtagtgttgccagaaggtgcaaacgcactggcaatgaaagaatcaatgtattcaagcggtgattactggaccccgtttcagggcttgcaaatgcagggcgctgaccacccccacacggagggtccgctgcaggcgcttatgggtctacgtactgtaggctcgtgcaccccgggcttagatgtaactataggcgggatactgcacccctattaccgcgaagtaatgcggactattggcccgttgaaaagagtggacctgtataacagcggaactttctacgaactctttggacctgcgcgaatcaccctagacagaaagttctgggaacgccgccgcgacttctatgagggcgaggacgtagtggttgggcgcgtagttgctagtgtagaagagttcaccggttacaaggtgcacaagcaggccgtgcagttattcgagcgcattatgcttgcgccagaagagcagcagcgtcacttatacactggctacgattacggcagacacatccgcgatggcaacgttgctgcgctgctcatgaagttgcacggtttcgtagtgtctagattcgccgtgcctttgggctttggtttccgcaacggcgaacctatcgtgatgctggggcagccgcggatgcacaaggacttcgctgcggttactgagtaccgctgtgtagagatgcgcgtaggtaggtggctcgctaactactacggcaatggcgtagacttccgcgatgctatcgaagacctcaaggctatgaacgtagagcctacaacgtacctgtgcaagaccgagcaagaatggtacgatgcctatgagaacggcccgagtagctgcatgagcgggtactcctttgagcatagccctgtgcggacgtacgctaccaccagccacgggctgccggataacgggctgcgcctgttcatccagtacactggggagctgttcggggacgacttcgaagtgcgggcacgagcaatcgtgaacaccgagactaaggagtatgtccgtgcttacggtaatgctgcggatgcaatcctgagggggcgtgggtacaccagaaacactgggtgtctcgaaggggtaatgctggcgcgtataccgcacccgcaatacagcggcgcagtgctgatgccctatctcgatagcgaccagtgcggtgttgatgaagaagggagtgacgcatttttgattcgtgacgactacaaatacgaggcgcaagaatcagaagggtacatctacgtcggcacagaatctgctcgatgctgctgctgcgaggggcgttactccattgatgatatgcatgaaaccgccgacggtgaaatgatctgcgacggctgtgtagaagatgaggaatttgtatatgtagttggccgagaagggctgcataatcgctggagctgcacttggtctgcttaccacgacgcctatgtatacgacagtgacctcgcgcactgtgcggtagaaggggcggttcacgaccaagcagaactggtatatgcacagggccgggaagtgcttgttgagcacgcagaagaacacccagtgcacgggttaattctcactgagcatgcggctgattgcctgggcgaggagtacctaggcaacgacgatgaagaagaagaagtagaggaggcagcttaatgttcttgaatccgcacgggattgatatgcagctgctcttgcagatactgcaaacgcaccggcctagctgggcgagcactaagtggtttgagccgctgcttatgcaagcgctgggtagtggtatgcactacgtaaaggacaagcacgggaactacttcgtgctggtgggagactcagagcaaagtgacgtagcgtttacgtctcatctcgacacagtggcgcgcccaaccagcgctgcgccggacgtcggctgcactaacaagggcgtgctgttcgtaaagaatccgcaacaagctgactgcttgggggcggactgcggtgctggtatatatctgatgctggagatgctacggcgcggggtgcatggacgctactgcttcttcgtggatgaagaggtaggctgcgagggtagcgctgcatcggtcaaggatgacactgggttttggactggtgtcaaggcgatgattagctttgaccgacgcggagacggtataatcacgcaccaacggtacatgcgctgctgctccgacacctttgccaaggagctggcgtctcgactggggcggacggacgcgcacctacagagagggatatacactgactctgctgagttcgtgcagattattccagagtgcactaacatcggcgtagggtacatgcacgagcatacaccagatgaagtgctggaccttagcattctcggtggcgtgctggggcacgtgcttagtccgggcacatttaaggacttgccgattgagcgtgaccctaaagtagtggagccggaccagtggctctctgcatcttcgcatcatttaatgtctattctggacgtgccccctgcggaggacccgcagttactggccgcgttccgggaagtgtcgcagctttctaaacaacaactagttagctgggtgcaggagaatccagcgaaggcggcggagtacataatggtgtactcagattatggcttcaaacaggagctgattgaactaggcacccgagtcgtagaagactggggcggatacgataatattgtggagggttgattatgtctaaactttttaaagtaggtgataagattcagcgcatcaataagattgaaggtaagaccatgcgcggcgaggtagtaactaaggggcctggactccatatcgacatcaagctaaccgaaggcgcagggattcattatgccggggatatctatggcggctctgccgacttctggcagctaaccgaggaggcggacgagctgccaccggttccgtctagtgtgacatatttaaacactaaacgagaccccggaaacgaccagcggctggtattagaaagagatagtgagactgatgaaggcctgctctacatagggatagtccctagaaagaacagtacccgggcagagcaagagattgggattaacatgagccccgacgcagccctgcagttggcgcacgatctgcgccgcatggctatggatatcaaacggaaggagaaagcacagtgagcaacgtcatagcgtacagtgtgatacgtacggtcgtagtaggcatcccctttacttggggaacccgcaacgcctgggctataaaggtggagagcggcggtatgtattacttatctaatgggcagaaggttctggaaacagaggaagagataatcgatgctgatatattttatgccaaccgcatcgagattaagtaatggaccagccatggcttagagcgtgcaagcgcctggccgtggggcagagggcacgctttcggtgctgcggcagggacgctgccggggtactatacaataaccctgatgcctgggaatattattgtcaccgctgcaagcaagtgggtaaggagcgcaagcagtaccagcgcatacagttacaggaagagccgagggtgcagccctctgcacctgcagatgcaatttgcattagccaagcgcctgcggaaacgcagagttttctttacggattcctgaccacaaagggaatcatgcctgaaatggtggaggatgcagaatggagcaaagagaaacagcggataatcttccgtgtcggaagcgctgctctaggccgtgcagtgcatgctcggcagcaaccgaagtgggtaatgtacggccagccaatagctttcgctgtcgcggcacctgccgtagcaccggctgtagctgcggccgcacctctaaaggtcgtgctcaccgaggactatctatcagcgatcaaatatcagcacgcgattacgaactactctgcaatgaacgtgcaggctatagctatgctgggtactcgcttgcccgtgcagttaagggcgtggctgatacagaacaaaccgacagtgatactgtccctggataatgaccaagcgggacactccggcgcggccatgatacggcgcgcgctacgtccctttatgtcgtgccacgaaatctactacgacggggacccaaaagaggcaacaatacaggagttattagatggtattaggcgcgtgtaaagagcacaaacagaaaggcggaccaaagggttacggaaataccacgttcaaagggcggaagatacccctgcatagaaaggtgtattgctcggagaacgatatatctccggagagcatagcggggctagttgtgcgccataagtgtgacaacccgagatgtattaatcccgagcatttagaattaggtacggtcaaggataacgtccatgactgcattgcccggggtagggctagacgtggagtttctaaaggggagcagaatgggtactccaagctaacagcgcagcaggtggactatatcaggaagacctacaggcggtacagcagggaacacggcacaccggccatagctgctagccttggtgtaagtgtgtcagcagtgcacgatgtattgaaagctaaaacttggaggctctaattggatctaatagttgttcgtgcaatgtgcacgcagaaggtgtggaaccgactgcgtgaacagatacccaagtccatgctcgcgccggatacgtcgaaccttctggactgggtagggttgtactggaacacgtacccggagcatcaggaagtgcagtgggatgcgatgcagagcatgctcaacctccgggcggggcacttatcccgggaagagcgggtaatcatggacgagcttatgcggggagtacaagccgtaccacaggattctgtggtggggattgtccagaccctgaatgagctggcctacagcggggaggtggcggcgcttacgcagcgctaccaagacggcgaggagattgattacctgctggaaatgaagcacctacagcgcaagtacggtgacggtgctgcggtgcatgagtcgctgcttgaatgggagagcggtagtgttgacgaaatacttgccgcgactgacgagagcggcggtcttaaacttggcgtgttcgagcaactcgctagcaacatccgaggtctacgcggcggggactgcatcgcagtggccgcccctgtggactctggtaaaactagcctgcttgctgctattgctgtggactttgctgagcagatgcagcaacagccggaagtatacggggaccgcccgattctctggctggttaacgagggtccggcgacgcgtacagtgccgagggtatatcaagcggcactgcactggactctggctgagattaaggaccggcacagtaagcaagagttcgtgccagcctacctcaagaaagtaggcagggctgaccggattcgtgttaaggctgcgcactccttgacgatggcccagatatccacgctcatggaggagatgcgccccgcggtaatcatcatcgacatggtggcgaatatccgtggcggcactatggagagtgagcaccagaacctcgaggcgaaatggcaggagctgcgcatcctggggtgcgagaacgactgtgctatcgtagggactatgcagctttcactcgaaggttacaacatgctgttcccgccgctcactgctatgaagcaaagcaagattggtgtacagggcgccttggacttggcgattatgatggggtgcttggacagaaacgagcagccgcacatgcaaaacgtccgcggtatcagcactcctaagaacaagatggcactatctggtaaagagtcgctcctgcaattcgaggtgggattcgagcctgggcgttgccgatttgacgagggtcagattaatgtctaaatttaaagcaggtgataaggtccgccgcacttctcgtttgtccctggagatgctacccccgtaccgggatacaaaaaggggggtgtatatactgtacgtgacgtaaactcctgggacaactccataagtctggttgaatctaaggatatcaacttctactttgatgctgacaaattcgaccacgaatcgtcctgggacgtaaacgaagcattgcgtctgcggggcttggcggtgcaggcgatacaggagtataacacgtacctgctgcagcagccgctgctagaggctattgatattccgccaatcaagtgacttccctagcgccttctatgagggcgctatgtaggtacacaggaggagattatgcttaaaccttcagacataaactatctcgacgacgaggtaatcaaggcgtacgctgcatctgcaggtacttcacgtaagagctatgcgcttgacagttcgcatatgattgtgctcttgtacatcaataaggcgcggagggctaactggaaatgaactggaaagaacacttcacgtacaaggatggtaagttatactggacccacacaagcccgaacggcgcatgtcagccgggcaagttggctggatacctagaaagacaccataaccgctgggtcgtgggattgcatgggaaggcatacaaacgtgctaggattgtttgggaaatgcaccacggagagatccctagtgggtgcgttatagaccacataaatcgcaaccgggaaggtgatcgtattgacaatctcagggcggttcctgttacactaaataatcgaaataaaaccatagataagcgcaacagttctggcgttcccggggtgacttatgatgccggacgaaaacgttgggcggcatacgtaaaccgtgacggaaagcaagtgcgtttgggaagattcccctcactggaagaggctgctgctgcaagagcggcagccgccaactccctgggatatttagaggtttagtatgtaccagattatgatagtggatttagaggtcgagaactttgagtattacggcaacgtggcatccccgtactgtcccgataactatgttgtagaaagcgcatatcgcatagacacagtagatgacgccgggcagttgcatatgggggacgtatttagtatccgcttcaacagcaaggccgagttcctggaagacaacgcaggtccccacaggtggttttccataccagaacactgcactatgatagtcgcgcacaacagcagcttcgaggtgtcctggttcttatcctaccagcggaaacatttcgaggacttcctaaagcgcggcggccgggtatactgtacgcagcacgggcagtacatagcctcagatttccaggagatgtatcctgggttagatgagaccgccccaaaatggggtggccagcacaaagttgatggtgtgaagatactatgggagcaagggaagcgtacttccgaaattgatccgtacctgcttcacgattacctcgtcaacggtgacgtgccaaataccgggttgtgcttctatgggcaatgcgccctattcgcccaacgcaatcagatgcagtatgtctatgaacgaatggaggcagcactagcttggagctattgtcaatggttcggcctgttcgttaatatgccgattgcacgcaagaaccaggaggagcaggagcagcgcatccgtgagattaagcaggagctgcagcagtacatcccgaaggacttgccggagactcttgacttcaacttcgggtcggacttccatatgtcagcactggtgtacggcgggcctatcaagtaccgcaagaaggtgccatatgacccgccgcagtacgtcaaggccggcttctataagtacgaggacgaagagggtgcgcacacctatatacctgtacacgacacgcacatgcaagaacttcaaacggaaggcggatggtggcgtgtagtgacatatcgtgcgggtaagaacaaggggctccccaaagtattccgcctcgataccgaggaagagaaacttaaatgggaagacgacctttacttctgcccgggcctggtgaacatccaggagcttccggaagttatccgggagaagtacgcagagcgcggagagttccgacaggcgcgcaccctgcaggacggtacgccagtatacagcaccagcactgacgcaatggaggcgctggctcgccaagggttcgagttctgtaagttggtgaacgagctggcggcgctggagaaggataccggcacttactatttgcgagaggtcctggacgcagaaggtaaggtcaaagagcgtaaggggatgctgcagtacgtaatcccggagcgtcccgatggttccggcatcattcaccaccggctgaatacttgcgccaccgtaaccggacgcttgagtagctctaacccgaacctgcagaacctaccccgcccggatgaggatggcgacggtgtggctaaatccaaggtgaagcaggtgttcaccagtagattcggggacaacggacgtatcactgaggttgactactcggcactggaagtggttatgtcctgcgtgcatacgggtgacaccaagctactggggctgctgcagggcggcacggatatgcactgttaccgcctagctttccgcgaggaactgccgtatgaagaagtatatgagcgctgccacaacaagaagcacgagctgcatccgctttggaaggcaatgcgtacaggtattaaggctcctagcttcgcagcccagtatggcgctacggctaaggggattgcgtttgctactggatgtacggtggaattcgcacaggctttcttggacaacgaggctgcgctgttcccgcaaacaattggcttccgcgctgttatcaaggaagaagtagagcgcaccggggcagccgggcgcatgtaccgcgagcaggctgacgatggcagctaccgaatctaccgcattgggacgtggaccagcccagccggtgcccgctacagcttccgccagaaggagcagtggaaggaagttgtgcccgggcagcgtaagcagaaggtaatggactacaaggaaactgagatggctaactattggtgccagggggaagcattctttctgatggcagtagcggccggtatggttcttcgtgcactcctggcccgtgactggttcgacaatcaggtgtgcctgattacgaacgtacacgatgcattgtatctggacagtgccaatccggaggttggacgtgaggcgagcctactggttaaacagtgcatggaggacgcgcctaagcgtatccaccagctctggcctaactacggtatcatcggcgaggtgcccttcccggcggaagctgaaatgggtacgagcatgtacagtaaggagaaggtagaatgaatattaaaccaggcagcattgtggaattactggaacttggacctgagccacttggcccagagttacggaagtacttcacacccggttcacagcaccgggttatctcttactgtaaagaaacttgggaggtagaactgatagaccctacgaatggctcagaagaacctggggatggtgttaccttcttcccgggggagtacaaacttatcgtggagtagtggtaggtgtacccttgggtggtgtagggtgttagggtatcatggaaatacactagggtcaactaaataattaaataaaattatttgttgactctggcttgattctgtgattcacagagaattaatgtgatacgagtaggaacaacacaagagaggaaaccttggctaaagtcagtctaataaaactattcacaaaagagcagcaccaggcaatcttgggccagtatctcgacaacgccctggctgctcagtattacaaccaggagctggataatcgtggggatgtggattcggacattagtgtgtcccgccagcttgtgcgttattggcgcagcatcttcatggataacaagggcagcaaggcaagggccaaccgagggctgcaggaggcgcgcaagctaatccaaccgagtccgacggacgacatcgggaatacacaggtgccggatatgtgtcaccgcattctggtggttggggacctgcacgctccctatacccacgtagacgcaatgcccttccttgagagcgtacgtgacgcctactgcccggacatggtggtgcaggttggcgacgaaactgatgggcacgcaatcagtttccacgactccgacccgaacctggacagtgccggggtggagctggagaaagctaagctcgtactggaggagctgcatgaactattcccgaacctactggtttgcgattccaatcacggctcactcgtatatcgccgcgctaaagctcacggtctgccagtgcaatttatcaagaagtaccgggacatcttattccctgagcatggtgctccggcatggtcgtgggccgatgcttgggttctcaatacaccactggggcctgtccgtttccaacatcaagtcagcggtgatttcatgctcaatgcatcccatgagcgcacctctctggtgctggggcacgagcatgggcgcttcgaggttcagtatgcggctagcagcacggcactgtactttggtgcgtatgcagggtgcttgattgaccgcaagagcatggcctttgcttacggcaagctcacccgcaagaaaccaatcctgggtgtgatggtaatcaccgagggttgcccgcagttaattccgatgctgctcgacgacgatggtcgttgggttggtcgttctaaataatatcgaggtgatgatgaaaatgggaatctgttctgtactgggccttatctttgtaaccctgaaactgactggcgttatcgcttggtcctggctgtgggtgctgctcccgttctggggacctgcggtgctcgccgtaatcctggtgtttctggcggcctctgtggcctccatacgctaagccctgcatctgcacgtaaatatcatttgaactaaacgaggacgtaattatatgactatgaatgcactggcatccctgaacgctctggtagacgcagcaatcgaaacccaagatgtagacatgcgggaaaccgcacagggcggtgcgtatgaggacgtactgctgccaaagggtgagtactacggctacttcaccgagtacgtggaaattggtaagcgcctgccgactaagggtggtaagcctaccggtaagcctgcagtggctaacgtacgcatcggcattgtagtgtacggccctaacggtgaagtgaagcgtatccgaccatacccgatggctatcagtaacttcgagcgcgcaggcttcaagaaattcttcgacaagctcaactacgataacagcattaagcatgctgcgcagcgtctgggccaggccttcacattcccgattgatgagcacactagcgcagcgggtaagaagtctaacatcgtggacctgtctggtatccgcccgattccgaagttcgacccgaacaccggcgagcctatcaagatgccagcgctggattcctccgagattaagctgttcctgtggaacaacccaaccaaagagacctgggatagcctacacatcgaaggcaccttcgacgacggtaagagcaagaactggattcaggaggatatgtacaaggccgtagacttcccgggcagtgctctggatattatgctgaacgctggttctgttccgagtccggcagctatgcaggcacctgctgctccttctgctccttctgctccttctgcaccggctgcccccgctgcaccgcaagcacctgcagccccagctgctccagtggctcccgcggctcctgtagcgcccgctgcgcctgctgcgcctcaagcctaatctaccctaacctaaactaatatggccccgcatggggccttagaggaagcctatgaacatcatcaacatccttatcaaactcctgagcgcagcctacacggccgaagctaaacgggccgatgccaaagcgcagtttaacgagcagctggcagttaaattcgcagacgacgcagtgcgtctggctgctcaatccgaggcgcgcgtagaggcctccaagcacagcaaagatgaagcaactaagcatgctgagcaggccgacaaactgcgcgctaagcgtgatgaagtagctaacttcctgggggggtgtaagtaatggataaagtattagacgcatacaagaaactggttctggcggtaggttacgcgaactgtggtgcagttcaaggtttcgacagtggtgaccaactcagcgctgtgtatgacgcactggacaagctggcggccctgtacggcatggacctggagctggccgctaccgcattccgggagcacaacgacctggcggcacatgccgataagttacggggcgacgacctagtgcttattcgtgtagttggcacgctaagcatcgggctggcggagattggttcctgcatctacgacgtagaccagagcctgcgtactccggaagtaatcggggacatgctcggcaccgtgctggttctgtctgaactggaggcttgagtatgctgtatgtatctcgcgcaatttacgtagctttgattctcccgctgatccccttggctggactatgctacctgggcgacaagctcagcaaggcaaagtgggcagagcgttgggttaactgggccgacaagaaggcccgagacattacgggggtctaatgattatcaacggggttgacttatcccagctcggggagcagttagctccgcagaactctgggaagattctgctgtacgacgcggacttttgcgtgtacaaagccgccgctacagtaaaacgtctggatacagcaatacgccgcttctatcagctggtgcttgaggacatgttcctggtaggttgctcagaagcagtggcgtacctgacgccagcagggtgcgccaagtgcctgcgctggcatctgcctacggctaagccgtaccaggggcagcgcgctaatcgacatgagctgccgctaaaggcaccgttgaagcggcacctgattgaaaatcccgatcaatattctgagcagggcatccaggtggtcagcagcgactacttcgaggcagatgacctcttcataatggattcgtacagctttggagaccgtggaatcctgatgtcccaggacaaggattcctggctaagccctatggcccgattcgatatcccgaccggaaccgtgtggcctgccttggataacccattcggttggattaagtgggatgatacccaggctatgccggtgcgagcacacggcaccaagttcttctggtggcagatgctagcaggggatgacgcagataacgtcaaaggcatcacattgcttgatgggaagctctgcgggaagcgaacggcctttgatgctatctaccctattacctcagagcaggacgccgcagaattcgttgtagcggcttatgctcgaaacaaccaagacgtactcgcagaggcggaatgcctgtggctgagacgctcccaatcagattcagcgtatctgtatctgatgtcactgttgactactcccagtctacgtgactgggtgcattcgctgcacgagtaccataaacagcatatacagtggatacaggagcacccagacaatggcgaagatgtctgcgaaggaaatgagcctgcgggcgattgagttatactacgaggggaaacacgatgaacttgaaactattctggatgcgctgcgtgaacgagcacccaaaacacatcgaagaacggttgagcatttggattctctcattcacgacaatgctatgctggatttagttggggagattgaattatggtaatgagtacaccgtgtatagaccacgggagaaaggggcggccaaagactgggttcctatccgcgtgggttcttattgatggtaaacgacaatctacaaccgcacacagaaaagcatactatgagcacacaggagagtggcctgaggtagtacagcacacctgtggaaatccgcgctgcattaaccccgagcacttgcagggagggacccacaaaagcaaagcagcaaagggctccggcagcggtcgctcacgtttgaacgaaggtacggtgcgttatctgcggcaaatgcacattcccggggaccgggaatggggtagcaacgctatagctagacgtctaggtatggctcacagtgtagtgtatcgtatgttaggagggattacatggcactgcgtaaaataacccgcgcacagattcgctctgttgctattaagcttgccaaagaccagggaggagtatgcctcctttgtggcaagcctttggacttcacaatcaagggggtaactggtgattctgttgtcgttgaccacgatcatattactgggcgtattcggggtgctcttcatcgctcgtgcaatggaggggaaggcaaagtggcatctgccgctgggcgctggattgttggtagcatgcaatcttctagggctattgctgaatctctacgtagggtcgccgattacttagaccgcgaacctacggatatgctatactatacacacaagacgccagaagaattggcacaggcacagaagctcaaggcccgcaaggcccgggcacgacgcaaagcacgggagactattaaatgagtaaattcaaagtgggtgatgtagttacgcgtcttgcacaacatagaaaaccgcactgggctcaattctgccacgagctgggcatgtcggacgggcaccctcttgttgttacagacacatttaacggccttttaatactggagggctgtaacggtcacacgtgggaccctgactgcttccaactgattagtacgacgagactaccgaaaagtactctgaaagcgcctgacgcagtaaactcccctcagcactaccagttcttcccggacctggaggcagtagaggtcattgcacgcagcatgacacaagagcagttctacgggtactgcctggggaaccggctcaagtaccgtctgagagccgggaacaaggataagctggagcaggacattgccaagtccgacaagtacttagaactgtacgagcaacaccgaggtaagtgcattgacgcctagcgaatggtgccacatgatgtggcagaaagcagtagagcggggcgacgaacgctccgctaaaaactacctggagatgtacaatctctgggtaagtcgcaatcagtagttagaagtaccggacataaccaaggagactaagcgcctatgattagcgccctgaatacggttgtagtgccagaggaagcactggtgaaacgccagctggagcttgaagagacctataagattcgcggaatcgagcgggcacgtaagctgattacggacgcattgcagaacggtgggattatgaacctgccgatgacgcagcgtatgctcacctcagcatacgaggtggctgctgctgctatcgatgagatgcgaaatgtcaaagcccctggcattggtgggaagtaccgccggttcctgcgcttaatccccttggatgtcctgacaaccctgagcctgtgcaccatgtttgaggcgttcagcgtcgcccctggcgagtccgccagtcgccgtcagactgcacaggcggtaatgtccgcactgggcagaaacgtacagtcagagctactggctctgcagttacgtaacgtagcccccgcgtacatggaccgtgtgtacgagtacctcactgagcgccgtacgaagtcccctacgcacatcctgcgtacgctccgtgccagtgccgagaacgtgcattacgggcacgagccttggaccaatgcccagaacatctccgtagggcgtctgctgtgcgccgcagtgtttgaaactggactgttccagtggaagaactgtagcgggaatctgagcatgctatatccggctgacgacgttatggaggccttccagaaactggtagagtccgctgataccgtaaccatgaagccgcctatgctggtaccgccggtgcagcacactactctgtgggatggtgggtacctcacccctatcgacaatcgcggaacctaccataactcacacattgacagagctcgtctccgggaagtagcggaagcatttaagtccgcggatggcatcaaaaaagcgcttaataaggcacaggaaaccccgtaccgtattaataagcgcatactggaactggtgcaagaagcacgggccctgggtgttgggataggtatgcctcgctcagtaccggagccgaaaccggagtggtatctggacggggttcctaaagagaactacacagaggaagagcttgaccgcttcggtgagtggaagacgcgtatgtccctatggtacagtgctgaccgtaagcgtgtatcgcaactacgcagccttctgactacgttggagatggcagaggaattcaaagatgagaaagccctgtacttcccgacttgtgtggactggcgctaccgcctgtacttcaagtcctcgctgcacccccaaggttctgatttgcagaaagcccttcttgaatttggacgtggtaaacctttgggggagcgtggacttttctggctcaaagtgcacgtcgccacatgctttggttatgacaagaccttattcgaagaccgcgcagcttgggttgatgcgaactttgcagagattgagcaactcacaatatctccgtttgattgccctgcttttgccaaggcagacagcccctggtgcttcctggcagccgctatcgacttggttaatgctgttcgttctggatgcccagaagagtatattagccgaatcccagtggctatggacgctacgaactcaggtgggcagcacctctcagcgctcctgagagaccctgtgggcggtcgtctgacgaacctgtactgggagggtaacgacaagaaagcggacctgtatatggatgtgaagcgccgtacggacgagaaggtgatactggacctggacaaggaggatttcgttatccagagcacttactggagagagaacgaaatcacccgcagcatgaccaagcgccccagtatgacctacttctacagcgccacggtgcgcagttgcagtgactacatctttgaaggcgcttgcgctgaggggtatgaaggtaccgacactaacagtctatggaatctgtcgtgctaccttgctccgcgtatgcgcgccgctatcgaggaggcaaaccccgctgctgcggcggttatggggtacttgcagaacctcgctaggcgtgtaccggcaagccagcacctgcagtggtatacgccgctgggtgggctcgtaatgaaccgctacacacagcgtgaagaagtgcgggtacgaattgactgtatgaacctcacaatcatgcgcgtgcataatcgggatttcaagacctgcaacaagcgcaaggcagcctcggggattgccccgaactttgtgcatagcctggatagtactcacttgatgatggttctatgtgccgccgagggtctggacattgtgccgattcacgactccctggctacacatgcagccgatgttgacgctctgcaccgacacatccgcgaacagtttgtgcgcctctacgaagagcacgacctgcttggagacattactcgcgcggcggcagctgccggggcggatttgacggacctggatatgcctgaggttggtactctggacatccggcaggtattggaatcacctttcttcttctgctgagggtatggtatgcgagtactagtaactggtgggcgggattacacagactacttagcactaaagaccgcaatggatatgctaccaaacaaaccatctgtagtgatacatggaaatgccagaggggcggacgcactggcagacaggtgggccctggaatctggtatttttgttctgcgcatgccagccctgtgggatgcgcagggtaaatctgcaggtatgcgcaggaacgccgccatgatatcattggcctttccagaatactgcgtcacctttcctggtgggaggggtaccgctggtatggttgagctatgcagaaaggccggtataccagtttgggtaccctactaaaatttaatgttaccggagtaggaatgaagttaaaacacactagtaaaacttccgactacactctcaaggttctgtataagtcagacgacattacagacgcagtgaagcaactgcacgaactgggccacggcattagtcggggcctggccccagagcagcactactggagagtactaggaagtatactgggtaaacagtatatactaggagtctatgactcccaaggcggcttagtcggcgctgtcagctactatccagaagctgtagaggactgtcattacgtagagcctgtgctatatacagacttcttcgtattgaagccggataacggcgcggcggtatctgtgattatgcagggcctgtatgcaatagccaagtgcatgcgcgctgggcgtatcgccattagccggagcacatcggataacacgtacaagacaacttatcatttagtgaggtcagaatgagtggtggtttaggtaaactgttaggcaaggccacggatatgctgggccttactgataacgcaggattagaggcgcagcagcgcttggcagagcagcaggctagcgcagcgaaacaacaggctgccttagaggctaatagcgccgcagataacattgctgagattgatcctgcaggggctgcctctgcatctgcagatgcaattacgtctgagcagaagaaacggcgacaagcagggcagagcaatcctctgggcctgtaagggggtagcttggaacaaaaagcaacattagcagaactctttaagaaggaccaggacgcgggcgtcttggatgcctctgagaagttcgcgcagtggacgctcagcactatctttaccagggacgattccctggacggtagacgcaggccgctggagcgggactaccagagtaccggtgcgcagctggtcaacactgcagccactaagattgtaggcgcactgttcccacaaggtactagtttcttccggttctccaagagttcggacctggacgagttcattagttcgctgggtagtgcagctactgcagaatctaagttggccgaggtcgagaacacggcgtcacagaaagtatttgagaaagacggttatgctgcgaagttgcaagctgtgaagctgctgctggttacaggtaacgcgttggagtatattgatgagcggacaggtaaatccatcgtctactcagtccgtaactttaccgttcgaagggatggcagcggtaacgtcctgcgactcattatcagagagcgcgcaagcgtccaggacctgccagaagatttccgtggcaccttctaccgtgacaaagacccatacggcgacgttgatatctacactgccgcttgtcgcaaagttaagcggacagaggacggtgcagaggtagtaagctacgaggtgtaccaagaagcagatggacaccgcatcggagagagcagcacctacccggagctggagcttccttacaacgtgctggtgtggaaccttgttagcggtgagcactacgggcgcggcttggtagaggactacgccggggacttcgccagattatcggtactgtcggaagcgttgactaactacgaggttgagtctgcgaggttaatcccgctgattgacgcaagctctgggttagacgtggacgagttctcaacgtcggagacgggtgaggctgtgcaggtgggcggtggtggttccaacgggaacagcaaatcccccgtcactgcttacgagggtggctctgcccagaagattcagtggattgccagcaacattcagatgctcgaacagaaactgtctcgtgcgtttatgtacaccggtaactcccggcagggtgagcgcgtcacggcttacgagattcgccagaatgccaaagaggcggaagctgctatgggtggtgggttcagtattctgagcgacacctggctgcgtaagctggcgtacctgtatactgcactggtgtatcctcgctttaagctttatctcagtgaaggtgtagtgaacatcaacgttactgtgggtacttctgcattagctaaagccgcggcagcagacaagctgttagaggcggcgcaatccatgcagctggctatcccggtgcttgagcagattactcctcgcttcaacaaagatgcgtgtgtagactggtacttcgacgcctacggtatcgttagcgagccgttcatgtacaccgaagagcagctgcagcagaagcaacaggttcagaatgcgtctgccgatgtatccgcaggtgccgcgcaggaccaactccagggcttgacagcagcagacccgacagtagcaggtaagcagctgggcttattaccaagttaacaacagaggcatagatggataacgtagaaaacggtcagaacgtagaaactacacaggtagagaaccaaggcggccctaagattccgggcctaggtgctccccttagcgccccgaacaatcaaggcgtgcaggatgcacagacccctacccagcagcaacagggcaaagattcccctgaacctgctaagattcctctggatatcgaagccttaaaagcgg

SEQ ID NO: 101 - DNA, 21 bp, Artificial sequence
  primer orf33+2-F
caatggcattaattagattag

SEQ ID NO: 102 - DNA, 21 bp, Artificial sequence
  primer orf33+2-R
gagagatatacctcccaggcc

---

What is claimed is:

1. An isolated polypeptide having degradation activity specific to the capsule of *Klebsiella pneumoniae* capsular type K1 strains, selected from the group consisting of: (a) a polypeptide comprising the amino acid sequence of SEQ ID NO: 2; (b) a polypeptide which is encoded by a polynucleotide which hybridizes under at least high stringency conditions with (i) the polypeptide coding sequence of SEQ ID NO: 1, or (ii) a full-length complementary strand of (i); and (c) a polypeptide which is encoded by the polynucleotide sequence of SEQ ID NO: 1, wherein the isolated polypeptide comprises a peptide tag.

2. The isolated polypeptide of claim 1, which has the amino acid sequence of SEQ ID NO: 2.

3. A vector containing an isolated polynucleotide, which comprises the nucleotide sequence of SEQ ID NO: 1 or a nucleotide sequence hybridizable under high stringency conditions to or complementary to the nucleotide sequence of SEQ ID NO: 1.

4. The vector of claim 3, wherein the isolated polynucleotide has a nucleotide sequence of SEQ ID NO: 1.

5. An isolated or recombinant bacteriophage specific to degrade capsule of *Klebsiella pneumoniae* capsular type K1 strains, which comprises the vector of claim 3.

6. The isolated polypeptide of claim 1, wherein the peptide tag is a poly-histidine tag.

* * * * *